US007105332B2

(12) United States Patent
Abad et al.

(10) Patent No.: US 7,105,332 B2
(45) Date of Patent: Sep. 12, 2006

(54) GENES ENCODING PROTEINS WITH PESTICIDAL ACTIVITY

(75) Inventors: André Abad, W. Des Moines, IA (US); Ronald D. Flannagan, Grimes, IA (US); Rafael Herrmann, Wilmington, DE (US); Theodore W. Kahn, Durham, NC (US); Albert L. Lu, Newark, DE (US); Billy F. McCutchen, Clive, IA (US); James K. Presnail, Avondale, PA (US); James F. H. Wong, Johnston, IA (US); Cao-Guo Yu, Urbandale, IA (US)

(73) Assignee: E.I. Du Pont de Nemours and Company, Wilmington, DE (US)

( * ) Notice: Subject to any disclaimer, the term of this patent is extended or adjusted under 35 U.S.C. 154(b) by 23 days.

(21) Appl. No.: 11/108,389

(22) Filed: Apr. 18, 2005

(65) Prior Publication Data

US 2005/0261188 A1 Nov. 24, 2005

Related U.S. Application Data

(62) Division of application No. 10/606,320, filed on Jun. 25, 2003, now abandoned.

(60) Provisional application No. 60/460,787, filed on Apr. 4, 2003, provisional application No. 60/391,786, filed on Jun. 26, 2002.

(51) Int. Cl.
*C12N 9/50* (2006.01)
*C12N 15/00* (2006.01)
*A61K 38/00* (2006.01)

(52) U.S. Cl. ................... 435/219; 800/279; 530/350
(58) Field of Classification Search ............... 800/279; 435/219
See application file for complete search history.

(56) References Cited

U.S. PATENT DOCUMENTS

| | | | |
|---|---|---|---|
| 5,554,534 | A | 9/1996 | Michaels et al. |
| 5,659,123 | A | 8/1997 | Van Rie et al. |
| 5,849,870 | A | 12/1998 | Warren et al. |
| 6,023,013 | A | 2/2000 | English et al. |
| 6,060,594 | A | 5/2000 | English et al. |
| 6,063,597 | A | 5/2000 | English et al. |
| 6,077,824 | A | 6/2000 | English et al. |
| 6,313,378 | B1 | 11/2001 | Baum et al. |
| 6,943,281 | B1 * | 9/2005 | Romano ............... 800/302 |
| 2002/0151709 | A1 * | 10/2002 | Abad et al. ............ 536/23.6 |
| 2003/0120054 | A1 | 6/2003 | Chen et al. |

FOREIGN PATENT DOCUMENTS

| | | |
|---|---|---|
| WO | WO 93/15206 | 8/1993 |
| WO | WO 96/10083 | 4/1996 |
| WO | WO 99/31248 | 6/1999 |
| WO | WO 02/34774 A2 | 5/2002 |
| WO | WO 03/018810 | 3/2003 |
| WO | WO-2004/003148 A2 | 1/2004 |

OTHER PUBLICATIONS

U.S. Appl. No. 10/746,914, filed Dec. 24, 2003, Lu.
Alves, L.C., et al., "S$_1$ Subsite Specificity of a Recombinant Cysteine Proteinase, CPB, of *Leishmania mexicana* Compared with Cruzain, Human Cathespin L and Papain Using Substrates Containing Non-Natural Basic Amino Acids," *Eur. J. Biochem.*, 2001, pp. 1206-1212.
Angsuthanasombat, C., et al., "Effects on Toxicity of Eliminating a Cleavage Site in a Predicted Interhelical Loop in *Bacillus thuringiensis* CryIVB δ-Endotoxin," *FEMS Microbiology Letters*, 1993, pp. 255-262, vol. 111, Elsevier Science, UK.
Aronson, A., and Shai, y., "Why *Bacillus thuringiensis* Insecticidal Toxins are so Effective: Unique Features of Their Mode of Action," *FEMS Microbiology Letters*, 2001, pp. 1-8, vol. 195, Elsevier Science, UK.
Audtho, et al., "Production of Chymotrypsin-Resistant *Bacillus thuringiensis* Cry2Aa1 delta-Endotoxin by Protein Engineering," *Applied and Environmental Microbiology*, 1999, pp. 4601-4605, vol. 65(10).
Bravo et al., "Characterization of *cry* Genes in a Mexican *Bacillus thuringiensis* Strain Collection," *Applied and Environmental Microbiology*. 1998, pp. 4965-4972, vol. 64(12).
Carlini, C.R. et al., "Biological Effects of Canatoxin, a Plant Toxic Protein, in Different Insect Models. Evidence for a Proteolytic Activation of the Toxin by Insect Cathepsin-Like Enzymes," *J. Econ. Entomol.*, 1997, pp. 340-348, vol. 90.
Carroll, J., et al., "Intromolecular Proteolytic Cleavage of *Bacillus thuringiensis* Cry3A δ-endotoxin May Facilitate its Coleopteran Toxicity," *Journal of Invertebrate Pathology*, 1997, pp. 41-49, vol. 70, Academic Press.
Chen, X., et al., "Mutations in Domain I of *Bacillus thuringiensis* δ-Endotoxin CryIAb Reduce the Irreversible Binding of Toxin in *Manduca sexta* Brush Border Membrane Vesicles," *Journal of Biological Chemistry*, 1995, pp. 6412-6419, vol. 270(11), USA.
Gazit, E., et al., "The Structure and Organization Within the Membrane of the Helices Composing the Pore-Forming Domain of *Bacillus thuringiensis* δ-Endotoxin are Consistant with an "Umbrella-Like" Structure of the Pore," *Proc. Natl. Acad. Sci USA*, 1998, pp. 12289-12294, vol. 951.

(Continued)

*Primary Examiner*—Maryam Monshipouri
*Assistant Examiner*—Suzanne M. Noakes
(74) *Attorney, Agent, or Firm*—Alston & Bird LLP

(57) ABSTRACT

The invention provides nucleic acids, and variants and fragments thereof, obtained from strains of *Bacillus thuringiensis* encoding δ-endotoxins having pesticidal activity against insect pests. The invention further provides mutagenized nucleic acids that have been modified to encode pesticidal polypeptides such as endotoxins having improved pesticidal activity and/or altered pest specificity. Particular embodiments of the invention provide isolated nucleic acids encoding pesticidal proteins that may be optimized as well as pesticidal compositions, expression cassettes, and transformed microorganisms and plants comprising a nucleic acid of the invention. These compositions find use in methods for controlling pests, especially plant pests.

7 Claims, 8 Drawing Sheets

OTHER PUBLICATIONS

Koiwa, H., et al., "A Plant Defensive Cystatin (Soyacystatin) Targets Cathepsin L-like Digestive Cysteine Proteinases (DvCALs) in the larval Midgut of Western Corn Rootworm (*Diabrotica virgifera virgifera*)," *FEBS Letters 471*, 2000, pp. 67-70.

Lambert, B., et al., "A *Bacillus thuringiensis* Insecticidal Crystal Protein with a High Activity against Members of the Family Noctuidae," 1996,*App. Env. Microbiol.* 62: 80-86.

Li, J., et al., "Crystal Structure of Insecticidal δ-Endotoxin from *Bacillus thuringiensis* at 2.5 Å Resolution," *Nature*, 1991, pp. 815-821, vol. 353.

Masson, L., et al., "Helix 4 of the *Bacillus thuringiensis* CryI Aa Toxin Lines the Lumen of the Ion Channel," *Journal of Biological Chemistry*, 1999, pp. 31996-32000, vol. 274(45).

Melo, R.L., et al., "Synthesis and Hydrolysis by Cysteine and Serine Proteases of Short Internally Quenched Fluorogenic Peptides," *Analytical Biochemistry*, 2001,pp. 71-77, vol. 23.

Naidu et al., "Screening of *Bacillus thuringiensis* Serotypes by Polymerase Chain Reaction (PCT) for Insecticidal Crystal Genes Toxic Against Coffee Berry Borer," *Indian Journal of Experimental Biology*, 2001, pp. 148-154. vol. 39.

Narva et al., "Novel Coleopteran-Active Toxins from *Bacillus thuringiensis*," 1993, XP-002218453.

Narva et al., "Novel Coleopteran-Active Toxins from *Bacillus thuringiensis*," 1993, XP-002218454.

Oppert, B., "Protease Interactions with *Bacillus thuringiensis* Insecticidal Toxins," *Arch. Insect Biochem. Physiol.* 1999, pp. 1-12, vol. 42, Wiley-Liss, Inc., USA.

Outchkourov, N.S., et al., "Expression of Sea Anemone Equistatin in Potato. Effects of Plant Proteases on Heterologous Protein Production," *Plant Physiology*, 2003, pp. 379-390.

Purcell, J.P., et al., "Examination of Midgut Luminal Proteinase Activities in Six Economically Important Insects," *Insect Biochem. Molec. Biol.*, 1992, pp. 41-47, vol. 22(1).

Schwartz, J., et al., "Restriction of Intramolecular Movements Within the CryI Aa Toxin Molecule of *Bacillus thuringiensis* Through Disulfide Bond Engineering," *FEBS Letters*, 1997, pp. 397-402, vol. 410.

Shiba, H., et al., "Involvement of Cathepsin B- and L-Like Proteinases in Silk Gland Histolysis During Metamorphosis of *Bombyx mori*," *Archives of Biochemistry and Biophysics*, 2001, pp. 28-34, vol. 390(1).

Sun et al., "Recent Developments in the Biotechnology of *Bacillus thuringiensis*," *Biotechnology Advances*, 2000, pp. 143-145, vol. 18(2).

Wu, D. and Aronson, A., "Localized Mutagenesis Defines Regions of the *Bacillus thuringiensis* δ-Endotoxin Involved in Toxicity and Specificity," *Journal of Biological Chemistry*, 1992, pp. 2311-2317, vol. 267(4).

Wu, S., et al., "Enhanced Toxicity of *Bacillus thuringiensis* Cry3A δ-Endotoxin in Coleopterans By Mutagenesis in a Receptor Binding Loop," *FEBS Letters*, 2000, pp. 227-232, vol. 473.

Dean, D.H., et al., "Probing the mechanism of action of *Bacillus thuringiensis* insecticidal proteins by site-directed mutagenesis—a minireview," 1996, *Gene*, pp. 111-117, vol. 179.

EMBL Database Report for Accession No. 022499, Jan. 1, 1998 (XP-002325016).

EMBL Database Report for Accession No. AY112465, May 28, 2002 (XP-002325017).

\* cited by examiner

GENES ENCODING PROTEINS WITH PESTICIDAL ACTIVITY

CROSS-REFERENCE PARAGRAPH

This application is a divisional application of U.S. patent application Ser. No. 10/606,320, filed Jun. 25, 2003 now abandoned, which claims the benefit of U.S. Provisional Application No. 60/460,787, filed Apr. 4, 2003, which claims the benefit of U.S. Provisional Application No. 60/391,786, filed Jun. 26, 2002, all of which are herein incorporated by reference in their entirety.

REFERENCE TO SEQUENCE LISTING SUBMITTED ON COMPACT DISC

The official copy of the sequence listing is submitted on compact disc (CD). Two CDs, labeled Copy 1 and Copy 2, containing an ASCII formatted sequence listing with a file named 291049SEQLIST.TXT, created on Apr. 12, 2005, and having a size of 618 kilobytes are filed concurrently with the specification. The sequence listing contained on these compact discs is part of the specification and is herein incorporated by reference in its entirety.

FIELD OF THE INVENTION

The present invention relates to naturally-occurring and recombinant nucleic acids that encode polypeptides characterized by pesticidal activity against insect pests. In some embodiments, nucleic acids were obtained from *Bacillus thuringiensis* Cry8-like genes that encode δ-endotoxins characterized by pesticidal activity against insect pests. Compositions and methods of the invention utilize the disclosed nucleic acids and their encoded pesticidal polypeptides to control plant pests.

BACKGROUND OF THE INVENTION

Insect pests are a major factor in the loss of the world's agricultural crops. For example, corn rootworm feeding damage or boll weevil damage can be economically devastating to agricultural producers. Insect pest-related crop loss from corn rootworm alone has reached one billion dollars a year.

Traditionally, the primary methods for impacting insect pest populations, such as corn rootworm populations, are crop rotation and the application of broad-spectrum synthetic chemical pesticides. However, consumers and government regulators alike are becoming increasingly concerned with the environmental hazards associated with the production and use of synthetic chemical pesticides. Because of such concerns, regulators have banned or limited the use of some of the more hazardous pesticides. Thus, there is substantial interest in developing alternative pesticides.

Biological control of insect pests of agricultural significance using a microbial agent, such as fungi, bacteria, or another species of insect affords an environmentally friendly and commercially attractive alternative. Generally speaking, the use of biopesticides presents a lower risk of pollution and environmental hazards, and provides a greater target specificity than is characteristic of traditional broad-spectrum chemical insecticides. In addition, biopesticides often cost less to produce and thus improve economic yield for a wide variety of crops.

Certain species of microorganisms of the genus *Bacillus* are known to possess pesticidal activity against a broad range of insect pests including *Lepidoptera, Diptera, Coleoptera, Hemiptera*, and others. *Bacillus thuringiensis* and *Bacillus papilliae* are among the most successful biocontrol agents discovered to date. Insect pathogenicity has been attributed to strains of: *B. larvae, B. lentimorbus, B. papilliae, B. sphaericus, B. thuringiensis* (Harwook, ed., (1989) *Bacillus* (Plenum Press), 306) and *B. cereus* (WO 96/10083). Pesticidal activity appears to be concentrated in parasporal crystalline protein inclusions, although pesticidal proteins have also been isolated from the vegetative growth stage of *Bacillus*. Several genes encoding these pesticidal proteins have been isolated and characterized (see, for example, U.S. Pat. Nos. 5,366,892 and 5,840,868).

Microbial pesticides, particularly those obtained from *Bacillus* strains, have played an important role in agriculture as alternatives to chemical pest control. Recently, agricultural scientists have developed crop plants with enhanced insect resistance by genetically engineering crop plants to produce pesticidal proteins from *Bacillus*. For example, corn and cotton plants genetically engineered to produce pesticidal proteins isolated from strains of *B. thuringiensis*, known as δ-endotoxins or Cry toxins (see, e.g., Aronson (2002) *Cell Mol. Life Sci.* 59(3): 417–425; Schnepf et al. (1998) *Microbiol Mol Biol Rev.* 62(3):775–806) are now widely used in American agriculture and have provided the farmer with an environmentally friendly alternative to traditional insect-control methods. In addition, potatoes genetically engineered to contain pesticidal Cry toxins have been sold to the American farmer. However, while they have proven to be very successful commercially, these genetically engineered, insect-resistant crop plants provide resistance to only a narrow range of the economically important insect pests. Some insects, such as Western corn rootworm, have proven to be recalcitrant.

Accordingly, efforts have been made to understand the mechanism of action of Bt toxins and to engineer toxins with improved properties. It has been shown that insect gut proteases can affect the impact of *Bacillus thuringiensis* Cry proteins and other pesticidal proteins on the insect. Some proteases activate Cry proteins by processing them from a "protoxin" form into a toxic form, or "toxin." See, Oppert (1999) *Arch. Insect Biochem. Phys.* 42: 1–12 and Carroll et al. (1997) *J. Invertebrate Pathology* 70: 41–49. This activation of the toxin can include the removal of the N- and C-terminal peptides from the protein and can also include internal cleavage of the protein. Other proteases can degrade pesticidal proteins. See Oppert, ibid.; see also U.S. Pat. Nos. 6,057,491 and 6,339,491.

Research has shown that insect gut proteases include cathepsins, such as cathepsin B- and L-like proteinases. See, Shiba et al. (2001) *Arch. Biochem. Biophys.* 390: 28–34; see also, Purcell et al. (1992) *Insect Biochem. Mol. Biol.* 22: 41–47. For example, cathepsin L-like digestive cysteine proteinases are found in the larval midgut of Western corn rootworm. See, Koiwa et al. (2000) *FEBS Letters* 471: 67–70; see also, Koiwa et al. (2000) *Analytical Biochemistry* 282: 153–155. The preferred proteolytic substrate sites of these proteases have been investigated using synthetic substrates. See, Alves et al. (2001) *Eur. J. Biochem.* 268: 1206–1212 and Melo et al. (2001) *Anal. Biochem.* 293: 71–77.

Although numerous investigators have attempted to make mutant pesticidal proteins, including endotoxin proteins, with improved pesticidal activity, few have succeeded. In fact, the majority of genetically engineered *B. thuringiensis* toxins that have been reported in the literature report endotoxin activity that is no better than that of the wild-type protein, and in many cases, the activity is decreased or destroyed altogether. Thus, new microbial pesticides having altered specificity and/or improved pesticidal activity are desired for use in pest-management strategies.

SUMMARY OF THE INVENTION

Compositions and methods are provided for impacting insect pests. More specifically, the invention relates to methods of impacting insect pests utilizing nucleic acids derived from pesticidal genes to produce transformed microorganisms and plants that express a pesticidal polypeptide of the invention. The compositions and methods of the invention find use in agriculture for controlling pests of many crop plants. Such pests include, but are not limited to, agriculturally significant pests, such as: Western corn rootworm, e.g., *Diabrotica virgifera virgifera*; Northern corn rootworm, *Diabrotica longicornis barberi*; Southern corn rootworm, *Diabrotica undecimpunctata howardi*; wireworms, *Melanotus* spp. and *Aeolus* spp.; boll weevil, e.g., *Anthonomus grandis*; Colorado potato beetle, *Leptinotarsa decemlineata*; and alfalfa weevil, *Hypera nigrirostris*.

The invention provides nucleic acids and fragments and variants thereof which encode polypeptides that possess pesticidal activity against insect pests. The wild-type (e.g., naturally occurring) nucleotide sequences of the invention obtained from strains of *Bacillus thuringiensis* encode Cry8-like δ-endotoxins. The invention further provides fragments and variants of nucleotide sequences that encode biologically active (e.g., pesticidal) polypeptides, and the invention thereby also provides fragments and variants of Cry8-like endotoxins. In some embodiments, the nucleotide sequences encode polypeptides that are pesticidal for at least one insect belonging to the order Coleoptera.

Other embodiments of the invention provide nucleic acids encoding truncated versions of a pesticidal protein that are characterized by pesticidal activity that is either equivalent to or improved relative to the activity of the corresponding full-length pesticidal protein. Some of the truncated nucleic acids of the invention can be referred to as either fragments or variants. In some embodiments, the nucleic acids of the invention are truncated at the 3' end or 5' end of a wild-type coding sequence. In other embodiments, nucleic acids of the invention comprise a contiguous sequence of nucleotides derived from another coding sequence of the invention that have been truncated at both the 5' and 3' ends.

The invention also pertains to pharmacokinetic studies which reveal novel mechanisms by which to explore the degradation and/or stability characteristics of a pesticidal protein utilizing both in vitro and in vivo conditions. Thus, the invention also provides for the design and production of mutant nucleotide sequences and their encoded amino acid sequences that confer additional properties on a polypeptide encoded by or comprising them. Based on these findings, multiple pharmacokinetic parameters of the pesticidal protein can be analyzed to predict, change and produce pesticidal polypeptides with improved pesticidal characteristics. For example, a combination of in vitro assays using previously identified, pest-specific proteases such as L-cathepsins, B-cathepsins, chymotrypsins, trypsins and the like, with or without known surrogate proteases, can be utilized to identify potential cleavage sites within a pesticidal molecule. Furthermore, these data can be combined with in vivo, insect midgut assays to produce data that provide a consensus understanding of those areas of the pesticidal protein which are most likely to be susceptible to proteolytic degradation and/or instability. In addition, midgut assays performed at various larval stages will produce data revealing potential differences in the susceptibility of the pesticidal protein to proteolytic degradation at different stages of larval development.

These data provide for nucleotide sequences that may encode a previously unknown protease recognition site, which renders a polypeptide containing it susceptible to digestion by the protease. These mutations may be placed in the context of a background sequence, such as a nucleic acid encoding a Bt toxin or other pesticidal protein, to provide proteins that have been engineered to have improved and/or altered pesticidal activities. For example, these mutations may be placed in the context of the pentin-1 protein (see U.S. Pat. Nos. 6,057,491 and 6,339,144, herein incorporated by reference) to provide proteins with improved and/or altered pesticidal properties, as demonstrated in Example 21.

In this manner, the invention provides an array of mutations that may be used individually or in combination to provide improved properties to an engineered pesticidal protein. The nucleic acids of the invention can be used to produce expression cassettes useful for the production of transformed microorganisms and plants. The resulting transformants can be used in the preparation of pesticidal compositions comprising a transformed microorganism, or for the production and isolation of pesticidal proteins, or for the production of pest resistant plants. Thus, the invention further provides pesticidal compositions comprising pesticidal polypeptides and/or transformed microorganisms as well as methods for producing and using such compositions. The pesticidal compositions of the invention find use in agricultural methods for impacting pests.

The invention further provides isolated pesticidal (e.g., insecticidal) polypeptides encoded by either a naturally occurring, or a modified (e.g., mutagenized or manipulated) nucleic acid of the invention. In particular examples, pesticidal proteins of the invention include pesticidal proteins such as pentin-1 like proteins, full-length δ-endotoxin proteins, fragments of full-length δ-endotoxins, and polypeptides that are produced from mutagenized nucleic acids designed to introduce particular amino acid sequences into the polypeptides of the invention. In particular embodiments, the polypeptides of the invention have enhanced pesticidal activity relative to the activity of the naturally occurring δ-endotoxin or other protein from which they are derived.

The nucleic acids of the invention can also be used to produce transgenic (e.g., transformed) plants that are characterized by genomes that comprise at least one stably incorporated nucleotide construct comprising a coding sequence of the invention operably linked to a promoter that drives expression of the encoded pesticidal polypeptide. Accordingly, transformed plant cells, plant tissues, plants, and seeds thereof are also provided.

In a particular embodiment, a transformed plant of the invention can be produced using a nucleic acid that has been optimized for increased expression in a host plant. For example, one of the pesticidal polypeptides of the invention can be back-translated to produce a nucleic acid comprising codons optimized for expression in a particular host, for example, a crop plant such as a *Zea mays* plant. Expression of a coding sequence by such a transformed plant (e.g., dicot or monocot) will result in the production of a pesticidal polypeptide and will confer increased pest resistance to the plant. In some embodiments, the invention provides transgenic plants expressing pesticidal polypeptides that find use in methods for impacting various insects and other pests.

BRIEF DESCRIPTION OF THE DRAWINGS

FIG. 1: Probit Analysis of 1218 Cry8-like (M6) Mutant against Colorado Potato Beetle (see Example 9). The log (concentration) of the toxin is graphed on the horizontal axis, while larval mortality is graphed on the vertical axis. The results of the probit analysis were: the $LC_{50}$ was 0.259 mg/ml; 95% fiducial limits were 0.171 mg/ml and 0.370 mg/ml. Observed mortality data points are represented by solid dots, while predicted mortality is represented by open squares. The 95% upper and lower limits are indicated by dashed lines.

FIG. 2: Effect of Wild Type 1218-1 on Colorado Potato Beetle Larval Mortality. The rate of application of wild type endotoxin in micrograms per square centimeter is arrayed on the horizontal axis and the percent mortality is shown on the vertical axis. Two replicates of the experiment are shown (bars with vertical stripes=replicate 1; bars with diagonal stripes=replicate 2).

FIG. 3: Effect of 1218 Cry8-like Mutant K03 on Colorado Potato Beetle Larval Mortality. The rate of application of wild type endotoxin in micrograms per square centimeter is arrayed on the horizontal axis and the percent mortality is shown on the vertical axis. Two replicates of the experiment are shown (bars with diagonal stripes=replicate 1; bars with horizontal stripes=replicate 2).

FIG. 4: Effect of 1218 Cry8-like Mutant K34 on Colorado Potato Beetle Larval Mortality. The rate of application of wild type endotoxin in micrograms per square centimeter is arrayed on the horizontal axis and the percent mortality is shown on the vertical axis. Two replicates of the experiment are shown (bars with diagonal stripes=replicate 1; bars with vertical stripes=replicate 2).

FIG. 5: Larval Assays with the Cotton Boll Weevil. This figure shows results of larval assays with the cotton boll weevil, as described in Experimental Example 13 and Table 9. Doses are arrayed on the horizontal axis, while combined larval weight in milligrams is shown on the vertical axis. K03 mutant data are shown by vertically-striped bars; M6 mutant data are shown by white bars; 1218-1 (wild type) data are shown by dotted bars; and the buffer control data are shown by diagonally-striped bars.

FIG. 6: Probit Analysis of Wild Type 1218-1 against Colorado Potato Beetle (see Example 6). The log (concentration) of the toxin is graphed on the horizontal axis, while larval mortality is graphed on the vertical axis. The results of the probit analysis were: at probability 0.50, concentration was 1.1098 mg/ml; 95% fiducial limits were 0.6859 and 2.4485. Observed mortality data points are represented by solid dots, while predicted mortality is represented by open squares. The 95% upper and lower limits are indicated by dashed lines.

FIG. 7: Probit Analysis of 1218 Cry8-like (K03) Mutant against Colorado Potato Beetle (see Example 6). The log (concentration) of the toxin is graphed on the horizontal axis, while larval mortality is graphed on the vertical axis. The results of the probit analysis were: at probability 0.50, concentration was 0.00808 mg/ml; 95% fiducial limits were 0.00467 and 0.01184. Observed mortality data points are represented by solid dots, while predicted mortality is represented by open squares. The 95% upper and lower limits are indicated by dashed lines.

FIG. 8: Distribution Analysis of Coding Regions from Maize (see Example 14). Maize cDNAs with full-length coding regions were analyzed for GC content and plotted as a function of their GC content (see top panel, "ORFs"). An EST-based "UniGene" dataset containing 84,085 sequences was also analyzed ("UniGenes," shown in lower panel).

DETAILED DESCRIPTION OF THE INVENTION

The invention is drawn to compositions and methods for impacting insect pests, particularly plant pests. More specifically, the isolated nucleic acids of the invention, and fragments and variants thereof, comprise nucleotide sequences that encode pesticidal polypeptides (e.g., proteins). The disclosed pesticidal proteins are biologically active (e.g., pesticidal) against insect pests such as insect pests of the order Coleoptera. Insect pests of interest include, but are not limited to: western corn rootworm, e.g., *Diabrotica virgifera virgifera*; northern corn rootworm, e.g., *Diabrotica longicornis barberi*; and southern corn rootworm, e.g., *Diabrotica undecimpunctata howardi*. Additional pests include: wireworms, *Melanotus, Eleodes, Conoderus*, and *Aeolus* spp.; Japanese beetle, *Popillia japonica*; white grub, *Phyllophaga crinita*; corn flea beetle, *Chaetocnema pulicaria*; sunflower stem weevil, *Cylindrocupturus adspersus*; gray sunflower seed weevil, *Smicronyx sordidus*; sunflower beetle, *Zygogramma exclamationis*; boll weevil, e.g., *Anthonomus grandis*; alfalfa weevil, *Hypera nigrirostris*; crucifer flea beetle, *Phyllotreta cruciferae*; Colorado potato beetle, *Leptinotarsa decemlineata*; striped flea beetle, *Phyllotreta striolata*; striped turnip flea beetle, *Phyllotreta nemorum*; and rape beetle, *Meligethes aeneus.*

The compositions of the invention comprise isolated nucleic acids, and fragments and variants thereof, that encode pesticidal polypeptides, expression cassettes comprising nucleotide sequences of the invention, isolated pesticidal proteins, and pesticidal compositions. In some embodiments, the invention provides modified Cry8-like δ-endotoxin proteins characterized by improved insecticidal activity against Coleopterans relative to the pesticidal activity of the corresponding wild-type protein. In other embodiments, the invention provides other pesticidal proteins, such as mutagenized pentin-1 like proteins, characterized by improved pesticidal activity against Coleopterans relative to the pesticidal activity of the corresponding wild-type, or non-mutagenized protein. The invention further provides plants and microorganisms transformed with these novel nucleic acids, and methods involving the use of such nucleic acids, pesticidal compositions, transformed organisms, and products thereof in impacting insect pests.

The nucleic acids and nucleotide sequences of the invention may be used to transform any organism to produce the encoded pesticidal proteins. Methods are provided that involve the use of such transformed organisms to impact or control plant pests. The nucleic acids and nucleotide sequences of the invention may also be used to transform organelles such as chloroplasts (McBride et al. (1995) *Biotechnology* 13:362–365; Kota et al. (1999) *Proc. Natl. Acad. Sci.* USA 96: 1840–1845).

The invention further relates to the identification of fragments and variants of the naturally-occurring coding sequence that encode biologically active pesticidal proteins. The nucleotide sequences of the invention find direct use in methods for impacting pests, particularly insect pests such as pests of the order Coleoptera. Pests of interest include, for example, the Colorado potato beetle, western corn rootworm, southern corn rootworm, northern corn rootworm, Mexican corn rootworm, wireworms, and boll weevil.

Figure 1:
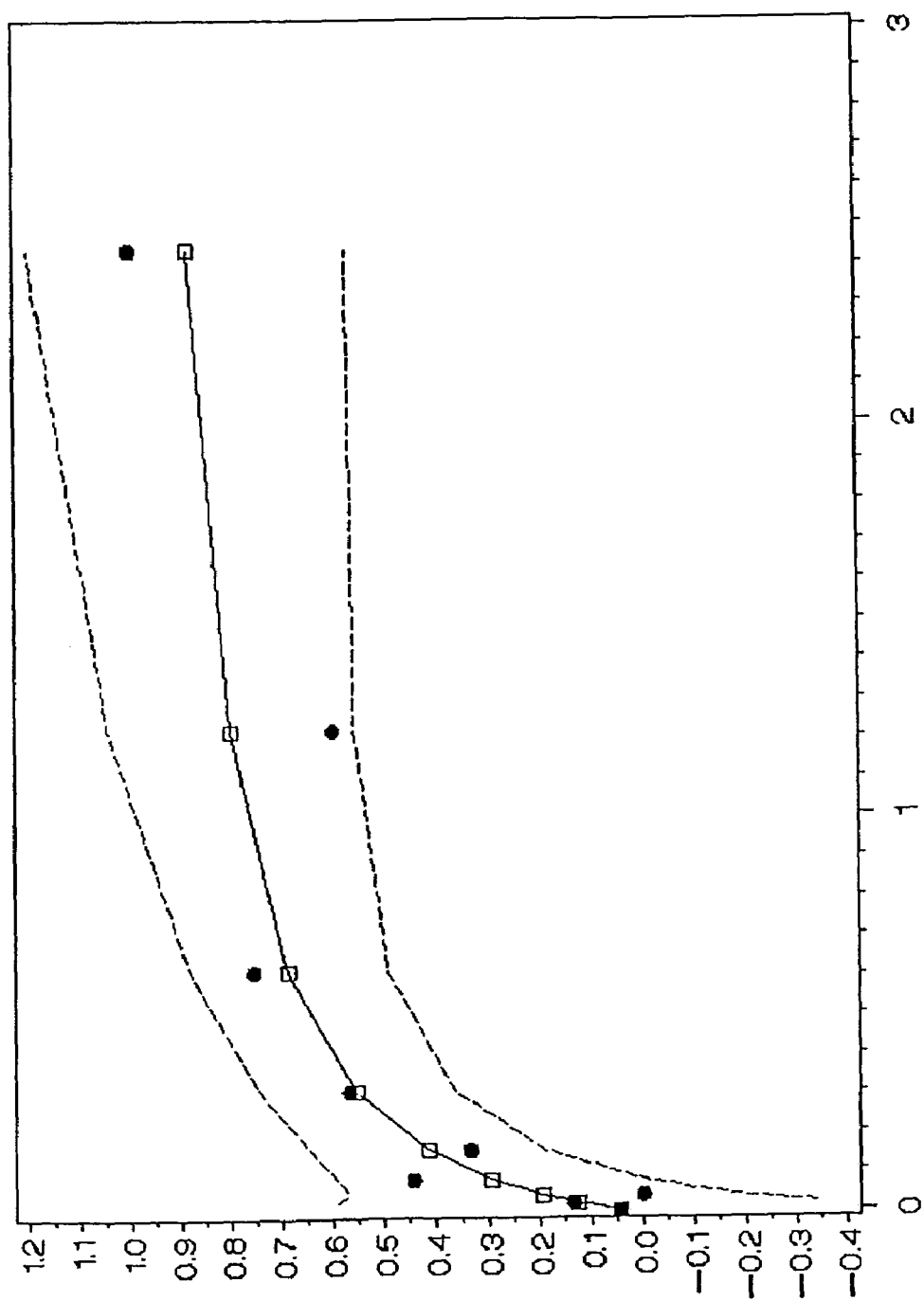

Accordingly, the present invention provides new approaches for impacting insect pests that do not depend on the use of traditional, synthetic chemical pesticides. The invention involves the discovery of naturally-occurring, biodegradable pesticides and the genes that encode them.

The invention further provides fragments and variants of the naturally occurring coding sequences that also encode biologically active (e.g., pesticidal) polypeptides. The nucleic acids of the invention encompass nucleic acid or nucleotide sequences that have been optimized for expression by the cells of a particular organism, for example nucleic acid sequences that have been back-translated (i.e., reverse translated) using plant-preferred codons based on the amino acid sequence of a polypeptide having enhanced pesticidal activity. The invention further provides mutations which confer improved or altered properties on polypeptides comprising them. The mutations of the invention may be utilized with any background sequence so long as the object of the invention is achieved, i.e., so long as the provided toxin exhibits altered or improved pesticidal activity.

In the description that follows, a number of terms are used extensively. The following definitions are provided to facilitate understanding of the invention.

As used herein, "nucleic acid" includes reference to a deoxyribonucleotide or ribonucleotide polymer in either single- or double-stranded form, and unless otherwise limited, encompasses known analogues (e.g., peptide nucleic acids) having the essential nature of natural nucleotides in that they hybridize to single-stranded nucleic acids in a manner similar to naturally occurring nucleotides.

As used herein, the terms "encoding" or "encoded" when used in the context of a specified nucleic acid mean that the nucleic acid comprises the requisite information to direct translation of the nucleotide sequence into a specified protein. The information by which a protein is encoded is specified by the use of codons. A nucleic acid encoding a protein may comprise non-translated sequences (e.g., introns) within translated regions of the nucleic acid or may lack such intervening non-translated sequences (e.g., as in cDNA).

As used herein, "full-length sequence" in reference to a specified polynucleotide or its encoded protein means having the entire nucleic acid sequence or the entire amino acid sequence of a native sequence. By "native sequence" is intended an endogenous sequence, i.e., a non-engineered sequence found in an organism's genome. A full-length polynucleotide encodes the full-length, catalytically active form of the specified protein.

As used herein, the term "antisense" used in the context of orientation of a nucleotide sequence refers to a duplex polynucleotide sequence that is operably linked to a promoter in an orientation where the antisense strand is transcribed. The antisense strand is sufficiently complementary to an endogenous transcription product such that translation of the endogenous transcription product is often inhibited. Thus, where the term "antisense" is used in the context of a particular nucleotide sequence, the term refers to the complementary strand of the reference transcription product.

The terms "polypeptide," "peptide," and "protein" are used interchangeably herein to refer to a polymer of amino acid residues. The terms apply to amino acid polymers in which one or more amino acid residues is an artificial chemical analogue of a corresponding naturally occurring amino acid, as well as to naturally occurring amino acid polymers.

The terms "residue" or "amino acid residue" or "amino acid" are used interchangeably herein to refer to an amino acid that is incorporated into a protein, polypeptide, or peptide (collectively "protein"). The amino acid may be a naturally occurring amino acid and, unless otherwise limited, may encompass known analogues of natural amino acids that can function in a similar manner as naturally occurring amino acids.

Polypeptides of the invention can be produced either from a nucleic acid disclosed herein, or by the use of standard molecular biology techniques. For example, a truncated protein of the invention can be produced by expression of a recombinant nucleic acid of the invention in an appropriate host cell, or alternatively by a combination of ex vivo procedures, such as protease digestion and purification.

As used herein, the terms "isolated" and "purified" are used interchangeably to refer to nucleic acids or polypeptides or biologically active portions thereof that are substantially or essentially free from components that normally accompany or interact with the nucleic acid or polypeptide as found in its naturally occurring environment. Thus, an isolated or purified nucleic acid or polypeptide is substantially free of other cellular material or culture medium when produced by recombinant techniques, or substantially free of chemical precursors or other chemicals when chemically synthesized.

An "isolated" nucleic acid is free of sequences (preferably protein-encoding sequences) that naturally flank the nucleic acid (i.e., sequences located at the 5' and 3' ends of the nucleic acid) in the genomic DNA of the organism from which the nucleic acid is derived. For example, in various embodiments, the isolated nucleic acids can contain less than about 5 kb, 4 kb, 3 kb, 2 kb, 1 kb, 0.5 kb, or 0.1 kb of nucleotide sequences that naturally flank the nucleic acids in genomic DNA of the cell from which the nucleic acid is derived.

As used herein, the term "isolated" or "purified" as it is used to refer to a polypeptide of the invention means that the isolated protein is substantially free of cellular material and includes preparations of protein having less than about 30%, 20%, 10%, or 5% (by dry weight) of contaminating protein. When the protein of the invention or biologically active portion thereof is recombinantly produced, preferably culture medium represents less than about 30%, 20%, 10%, or 5% (by dry weight) of chemical precursors or non-protein-of-interest chemicals.

As used herein, the term "impacting insect pests" refers to effecting changes in insect feeding, growth, and/or behavior at any stage of development, including but not limited to: killing the insect; retarding growth; preventing reproductive capability; antifeedant activity; and the like.

As used herein, the terms "pesticidal activity" and "insecticidal activity" are used synonymously to refer to activity of an organism or a substance (such as, for example, a protein) that can be measured by but is not limited to pest mortality, pest weight loss, pest repellency, and other behavioral and physical changes of a pest after feeding and exposure for an appropriate length of time. In this manner, pesticidal activity impacts at least one measurable parameter of pest fitness. For example "pesticidal proteins" are proteins that display pesticidal activity by themselves or in combination with other proteins. Endotoxins are pesticidal proteins. Other examples of pesticidal proteins include, e.g., pentin-1 (see U.S. Pat. Nos. 6,057,491 and 6,339,144).

The term "pesticidally effective amount" connotes a quantity of a substance or organism that has pesticidal activity when present in the environment of a pest. For each substance or organism, the pesticidally effective amount is determined empirically for each pest affected in a specific environment. Similarly, an "insecticidally effective amount" may be used to refer to a "pesticidally effective amount" when the pest is an insect pest.

As used herein the term "recombinantly engineered" or "engineered" connotes the utilization of recombinant DNA technology to introduce (e.g., engineer) a change in the protein structure based on an understanding of the protein's mechanism of action and a consideration of the amino acids being introduced, deleted, or substituted.

As used herein the term "mutant nucleotide sequence" or "mutation" or "mutagenized nucleotide sequence" connotes a nucleotide sequence that has been mutagenized or altered to contain one or more nucleotide residues (e.g., base pair) that is not present in the corresponding wild-type or non-mutagenized sequence. Such mutagenesis or alteration consists of one or more additions, deletions, or substitutions or replacements of nucleic acid residues. When mutations are made by adding, removing, or replacing an amino acid of a proteolytic site, such addition, removal, or replacement may be within or adjacent to the proteolytic site motif, so long as the object of the mutation is accomplished (i.e., so long as proteolysis at the site is changed).

A mutant nucleotide sequence can encode a mutant δ-endotoxin showing improved or decreased insecticidal activity or an amino acid sequence which confers improved or decreased insecticidal activity on a polypeptide containing it. Similarly, by "mutant" or "mutation" in the context of a protein is intended a polypeptide or amino acid sequence which has been mutagenized or altered to contain one or more amino acid residues that is not present in the corresponding wild-type or non-mutagenized sequence. Such mutagenesis or alteration consists of one or more additions, deletions, or substitutions or replacements of amino acid residues. A mutant polypeptide shows improved or decreased insecticidal activity or an amino acid sequence which confers improved insecticidal activity on a polypeptide containing it. Thus, by "mutant" or "mutation" may be intended either or both of the mutant nucleotide sequence and the encoded amino acids. In some embodiments, the mutant nucleotide sequences are placed into a sequence background previously known in the art, such as Cry3A, to confer improved properties on the encoded polypeptide. Mutants may be used alone or in any compatible combination with other mutants of the invention or with other mutants. Where more than one mutation is added to a particular nucleic acid or protein, the mutations may be added at the same time or sequentially; if sequentially, mutations may be added in any suitable order. Thus, a sequence of the invention may be a mutagenized nucleotide sequence or an optimized nucleotide sequence, or a sequence of the invention may be both mutagenized and optimized.

As used herein the term "improved insecticidal activity" or "improved pesticidal activity" characterizes a polypeptide or encoded polypeptide endotoxin of the invention that has enhanced Coleopteran pesticidal activity relative to the activity of its corresponding wild-type protein, and/or an endotoxin that is effective against a broader range of insects, and/or an endotoxin having specificity for an insect that is not susceptible to the toxicity of the wild-type protein. A finding of improved or enhanced pesticidal activity requires a demonstration of an increase of toxicity of at least 10%, against the insect target, and more preferably 20%, 25%, 30%, 35%, 40%, 45%, 50%, 60%, 70%, 100%, 200%, or greater increase of toxicity relative to the insecticidal activity of the wild-type endotoxin determined against the same insect.

For example, an improved pesticidal or insecticidal activity is provided where a wider or narrower range of insects is impacted by the polypeptide relative to the range of insects that is affected by a pesticidal protein such as wild-type Bt toxin. A wider range of impact may be desirable where versatility is desired, while a narrower range of impact may be desirable where, for example, beneficial insects might otherwise be impacted by use or presence of the toxin. While the invention is not bound by any particular mechanism of action, an improved pesticidal activity may also be provided by changes in one or more characteristics of a polypeptide; for example, the stability or longevity of a polypeptide in an insect gut may be increased relative to the stability or longevity of a corresponding wild-type or non-mutagenized protein.

By "toxin" or "endotoxin" is intended a polypeptide showing pesticidal activity or insecticidal activity or improved pesticidal activity or improved insecticidal activity. In some instances, polypeptide endotoxins of the invention and the nucleotide sequences encoding them will share a high degree of sequence identity or similarity to wild-type 1218 Cry8-like sequences. By "Cry8-like" is intended that the nucleotide or amino acid sequence shares a high degree of sequence identity or similarity to previously described sequences categorized as Cry8. Similarly, by "pentin-1 like" is intended that the nucleotide or amino acid sequence shares a high degree of sequence identity or similarity to previously described pentin-1 sequences (see U.S. Pat. Nos. 6,057,491 and 6,339,144). By "Bt" or "*Bacillus thuringiensis*" toxin or endotoxin is intended the broader class of toxins found in various strains of *Bacillus thuringiensis*, which includes such toxins as, for example, Cry3A or Cry3B.

By "proteolytic site" or "cleavage site" is intended an amino acid sequence which confers sensitivity to a class of proteases or a particular protease such that a polypeptide containing the amino acid sequence is digested by the class of proteases or particular protease. A proteolytic site is said to be "sensitive" to the protease(s) that recognize that site. It is recognized that the efficiency of digestion will vary, and that a decrease in efficiency of digestion can lead to an increase in stability or longevity of the polypeptide in an insect gut. Thus, a proteolytic site may confer sensitivity to more than one protease or class of proteases, but the efficiency of digestion at that site by various proteases may vary.

Proteolytic sites include, for example, trypsin sites, chymotrypsin sites, papain sites, cathepsin sites, and cathepsin-like sites. Proteolytic sites for particular proteases often comprise "motifs," or sequence patterns, which are known to confer sensitivity to a particular protease. Thus, for example, cathepsin site motifs include FRR, a cathepsin L protease cleavage site; RR, a trypsin and cathepsin B cleavage site; LKM, a chymotrypsin site; and FF, a cathepsin D site. A putative proteolytic site is a sequence that comprises a motif or comprises a sequence similar to a motif but which has not been shown to be subject to digestion by the corresponding protease. Units, prefixes, and symbols may be denoted in their SI accepted form. Unless otherwise indicated, nucleic acids are written left to right in 5' to 3' orientation; amino acid sequences are written left to right in amino to carboxy orientation, respectively. Numeric ranges are inclusive of the numbers defining the range. Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes. The above-defined terms are more fully defined by reference to the specification as a whole.

It is well known that naturally-occurring δ-endotoxins are synthesized by *B. thuringiensis* sporulating cells as a proteinaceous crystalline inclusion protoxin. Upon being ingested by susceptible insect larvae, the microcrystals dissolve in the midgut, and the protoxin is transformed into a biologically active moiety by proteases characteristic of digestive enzymes located in the insect gut. The activated δ-endotoxin binds with high affinity to protein receptors on brush-border membrane vesicles. The epithelial cells lining the midgut are the primary target of the endotoxin and are rapidly destroyed as a consequence of membrane perforation resulting from the formation of gated, cation-selective channels by the toxin.

In an effort to better characterize and improve Bt toxins, strains of the bacterium *Bacillus thuringiensis* were studied. Crystal preparations prepared from cultures of the *Bacillus thuringiensis* strains were discovered to have pesticidal activity against Colorado potato beetle, western corn rootworm, and southern corn rootworm. Crystal proteins were isolated from cultures of the strains. The isolated crystal proteins were tested for pesticidal activity in insect feeding assays. The results of the assays revealed that the isolated crystal proteins possessed Coleopteran pesticidal activity.

A comparison of the amino acid sequences of Cry toxins of different specificities reveals five highly-conserved sequence blocks. Structurally, the δ-endotoxins comprise three distinct domains which are, from the N- to C-terminus: a cluster of seven alpha-helices implicated in pore formation (referred to as "domain 1"), three anti-parallel beta sheets implicated in cell binding (referred to as "domain 2"), and a beta sandwich (referred to as "domain 3"). The location and properties of these domains are known to those of skill in the art. See, for example, Li et al. (1991) *Nature*, 305:815–821 and Morse et al. (2001) *Structure*, 9:409–417.

An effort was undertaken to identify nucleotide sequences encoding crystal proteins from the strains, and the wild-type (i.e., naturally occurring) nucleic acids of the invention were isolated from the bacterial strains. The nucleotide sequences of the isolated nucleic acids were demonstrated to encode pesticidal proteins by transforming *Escherichia coli* with such nucleotide sequences. Lysates prepared from the transformed *E. coli* had pesticidal activity against corn rootworms, Colorado potato beetles and cotton boll weevils in feeding assays, demonstrating that the isolated nucleotide sequences of the invention encode pesticidal proteins. Depending upon the characteristics of a given lysate preparation, it was recognized that the demonstration of pesticidal activity sometimes required trypsin pretreatment to activate the pesticidal proteins.

The inventors identified nucleic acid variants and fragments encoding biologically active pesticidal polypeptides. Some of the encoded pesticidal proteins require protease digestion (e.g., by trypsin, chymotrypsin, and the like) for activation, while other proteins were observed to be biologically active (e.g., pesticidal) in the absence of activation. In some embodiments, the nucleic acid encodes a truncated version of the naturally occurring polypeptide and as such, can be classified either as a variant or a fragment.

Further, the inventors determined that the Cry8-like proteins of the invention were likely to be useful in transgenic products. Surface plasmon resonance was used to determine the binding kinetics of the wild-type endotoxin known as 1218-1 to western corn rootworm midgut brush border membrane vesicles. Western corn rootworm brush border membrane vesicles were adhered to a hydrophobic sensor chip and 1218-1 toxin was passed over the surface at various concentrations while monitoring real time binding. Five concentrations of toxin were used to generate a series of binding curves which were analyzed using a standard 1:1 binding model. The analysis generated a KD in the low $10^{-9}$ range. This KD range is consistent with current insecticidal toxins that have become agricultural transgenic products.

In addition, nucleic acid sequences were engineered to encode Cry8-like polypeptides that contain additional mutations that confer improved or altered pesticidal activity relative to the pesticidal activity of the naturally occurring polypeptide. Thus, the nucleotide sequences of these nucleic acids comprise mutations not found in the wild type sequences.

The mutant Cry8-like polypeptides of the present invention were generally prepared by a process that involved the steps of: obtaining a nucleic acid sequence encoding a Cry8-like polypeptide; analyzing the structure of the polypeptide to identify particular "target" sites for mutagenesis of the underlying gene sequence based on a consideration of the proposed function of the target domain in the mode of action of the endotoxin; introducing one or more mutations into the nucleic acid sequence to produce a desired change in one or more amino acid residues of the encoded polypeptide sequence; and assaying the polypeptide produced for pesticidal activity.

Many of the δ-endotoxins are related to various degrees by similarities in their amino acid sequences and tertiary structure, and means for obtaining the crystal structures of *B. thuringiensis* endotoxins are well known. Exemplary high-resolution crystal structure solution of both the Cry3A and Cry3B polypeptides are available in the literature. The inventors of the present invention used the solved structure of the Cry3A gene (Li et al. (1991) *Nature* 353:815–821) to produce a homology model of the Cry8-like δ-endotoxin disclosed herein as SEQ ID NO:2, and known as Cry8Bb1 (see Genbank Accession No. CAD57542), to gain insight into the relationship between structure and function of the endotoxin and to design the recombinantly engineered proteins disclosed herein. A combined consideration of the published structural analyses of *B. thuringiensis* endotoxins and the reported function associated with particular structures, motifs, and the like indicates that specific regions of the endotoxin are correlated with particular functions and discrete steps of the mode of action of the protein. For example, δ-endotoxins isolated from *B. thuringiensis* are generally described as comprising three domains, a seven-helix bundle that is involved in pore formation, a three-sheet domain that has been implicated in receptor binding, and a beta-sandwich motif (Li et al. (1991) *Nature*, 305:815–821).

The inventors reasoned that the toxicity of Cry8-like proteins, particularly the toxicity of the Cry8-like protein of the invention, 1218-1, could be improved by targeting the region located between alpha helices 3 and 4 of domain 1 of the endotoxin protein. This theory was premised on a body of knowledge concerning endotoxins, including: 1) that alpha helices 4 and 5 of domain 1 of Cry3A δ-endotoxins had been reported to insert into the lipid bilayer of cells lining the midgut of susceptible insects (Gazit et al., (1998) *PNAS USA* 95:12289–12294); 2) the inventors' knowledge of the location of trypsin and chymotrypsin cleavage cites within the amino acid sequence of the wild-type protein; 3) the observation reported herein that the protein encoded by the wild-type endotoxin 1218-1 (i.e., SEQ ID NO:2) was more active against certain *Coleopterans* following in vitro activation by trypsin or chymotrypsin treatment; and 4)

reports that digestion of toxins from the 3' end resulted in decreased toxicity to insects. Accordingly, the inventors engineered a series of mutants and placed them in a variety of background sequences to create novel polypeptides having enhanced or altered pesticidal activity. These mutants included, but were not limited to: the addition of at least one more protease-sensitive site (e.g., Cry8 trypsin cleavage site) in the region located between helices 3 and 4 of domain 1; the replacement of the original protease-sensitive site in the wild-type sequence with a different protease-sensitive site; the addition of multiple protease-sensitive sites in a particular location; the addition of amino acid residues near protease-sensitive site(s) to alter folding of the polypeptide and thus enhance digestion of the polypeptide at the protease-sensitive site(s); and adding mutations to protect the polypeptide from degradative digestion that reduces toxicity, (e.g., making a series of mutations wherein the wild-type amino acid is replaced by valine to protect the polypeptide from digestion). Mutations may be used singly or in any combination to provide polypeptides of the invention.

In this manner, the invention provides a variety of mutations, such as, for example, a mutation that comprises an additional, or an alternative, protease-sensitive site located in domain 1 of the polypeptide variant in a region that is located between alpha-helices 3 and 4 of the encoded polypeptide. A mutation of the invention which is an additional or alternative protease-sensitive site may be sensitive to several classes of proteases such as serine proteases, which include trypsin and chymotrypsin, or cysteine proteases, such as cathepsin. Thus, a mutation which is an additional or alternative protease-sensitive site may be designed so that the site is readily recognized and/or cleaved by a category of proteases, such as mammalian proteases or insect proteases. A protease-sensitive site of the invention may also be designed to be cleaved by a particular class of enzymes or a particular enzyme known to be produced in an organism, such as, for example, a cathepsin produced by the alfalfa weevil, *Hypera postica* (Wilhite et al., (2000), *Insect Biochemistry and Molecular Biology*, 30(12): 1181–1188). Another mutation of the invention is, for example, a mutation that confers resistance to proteolytic digestion by chymotrypsin at the C-terminus of the peptide.

As demonstrated herein, the presence of an additional and/or alternative protease-sensitive site in the amino acid sequence of the encoded polypeptide can improve the pesticidal activity and/or specificity of the polypeptide encoded by the nucleic acids of the invention. Accordingly, the Cry8-like nucleotide sequences of the invention can be recombinantly engineered or manipulated to produce polypeptides having improved or altered insecticidal activity and/or specificity compared to that of an unmodified wild-type δ-endotoxin. In addition, the mutations disclosed herein may be placed in or used in conjunction with other nucleotide sequences to provide improved properties. For example, a protease-sensitive site that is readily cleaved by insect cathepsin, e.g., a cathepsin found in the alfalfa weevil or the western corn rootworm (Wilhite et al. (2000), *Insect Biochemistry and Molecular Biology* 30(12): 1181–1188; Koiwa et al. (2000), *Analytical Biochemistry* 282: 153–155; Koiwa et al. (2000), *FEBS Letters* 471: 67–70), may be placed in a Cry3A, Cry3B, or Cry8 background sequence to provide improved toxicity to that sequence. In this manner, the invention provides toxic polypeptides with improved properties.

For example, one type of nucleic acid (e.g., mutagenized Cry8-like nucleotide sequence) disclosed herein provides additional mutants that comprise additional codons that introduce a second trypsin-sensitive amino acid sequence (in addition to the naturally occurring trypsin site) into its encoded polypeptide. An alternative addition mutant of the invention comprises additional codons designed to introduce at least one additional different protease-sensitive site into the polypeptide, for example, a chymotrypsin-sensitive site located immediately 5' or 3' of the naturally occurring trypsin site.

A second alternative type of variant nucleic acid of the invention provides substitution mutants in which at least one codon of the nucleic acid that encodes the naturally occurring protease-sensitive site is destroyed, and alternative codons are introduced into the variant nucleic acid sequence in order to introduce a different (e.g., substitute) protease-sensitive site in its place. In a particular embodiment of this variant polynucleotide, a replacement mutant is disclosed in which the naturally-occurring trypsin cleavage site present in the encoded polypeptide is destroyed and a chymotrypsin cleavage site is introduced into its place. In another particular embodiment of this variant polynucleotide, a replacement mutant is disclosed in which a cathepsin cleavage site is introduced in place of the naturally-occurring trypsin cleavage site. Another nucleic acid of the invention provides mutagenized nucleic acids encoding polypeptides which are resistant to proteolytic digestion by chymotrypsin. One of skill in the art will recognize that any of the disclosed mutations can be engineered in any polynucleotide sequence; accordingly, variants of full-length Cry8-like or Bt endotoxins, or pentin-1 like proteins, or fragments thereof, can be modified to contain additional or alternative cleavage sites as well as to be resistant to proteolytic digestion. In this manner, the invention provides Cry8-like endotoxins or pentin-1 like proteins containing mutations that improve pesticidal activity as well as improved compositions and methods for impacting pests using pesticidal proteins such as, for example, other Bt toxins.

The NGSR mutants disclosed herein comprise at least one additional trypsin-sensitive protease site. These sites may be provided in a region of the amino acid sequence that encodes domain 1 of the endotoxin polypeptide, for example, between helices 3 and 4. For example, the NGSR.N1218-1 mutant set forth in SEQ ID NO:8 comprises an NGSR sequence introduced between amino acid residues 164 and 165 of the wild-type protein (designated 164-NGSR-165). This amino acid sequence provides a second trypsin-sensitive cleavage site in the mutant endotoxin encoded by SEQ ID NO:7. More specifically, the NGSR sequence (e.g., SEQ ID NO:10) in NGSR.N1218-1 duplicates the endogenous trypsin cleavage site that is present at the target location, thereby introducing a second protease-sensitive site into the loop region located between alpha helices 3 and 4 of domain 1. Thus, while the wild-type protein comprises the sequence NGSR at this location, the amino acid sequence of SEQ ID NO:8 includes an additional protease-sensitive site and the amino acid sequence NGSRNGSR (SEQ ID NO: 110).

The sequence set forth in SEQ ID NO: 22 contains several mutations, including the "KO mutation" which replaces the NGSR sequence of the wild-type protein with the sequence FRRGFRRG (SEQ ID NO: 98). Thus, the FRRGFRRG sequence comprises a duplicated cathepsin site ((Wilhite et al. (2000) *Insect Biochemistry and Molecular Biology* 30(12): 1181–1188; Thie et al. (1990) *Insect Biochemistry* 20(3): 313–318; Shiba-Hajime et al. (2001) *Archives of Biochemistry and Biophysics* 390(1): 28–34; Melo et al. (2001) *Analytical Biochemistry* 293(1): 71–77; Filippova et al. (2000) *Bioorganicheskaya-Khimiya* 26(3): 192–196; Gacko et al. (2000) *Bulletin of the Polish Academy of*

Sciences Biological Sciences 48(1): 11–15; Pimenta et al. (2000) *Journal of Protein Chemistry* 19(5): 411–418) that is not present in the wild-type 1218-1 polypeptide. Specifically, these additional cathepsin-sensitive cleavage sites are added to the protein loop region between helix 3 and helix 4 of the protein.

While the invention is not bound by any particular theory of operation, it is believed that the presence of a second protease-sensitive (e.g., trypsin, chymotrypsin, or cathepsin) site between helices 3 and 4 of these endotoxins facilitates intramolecular proteolytic cleavage by enhancing the ability of helices 4 and 5 to separate from the rest of the toxin. The effects of enhancing the ability of helices 4 and 5 to separate from the rest of the toxin would be manifest as a more efficient pore-forming process and hence confer an increase in the pesticidal or insecticidal activity of the toxin. Indeed, the Cry8-like mutants described herein show improved toxicity towards several *Coleopteran* pests. The data further suggests that the presence of two or more protease-sensitive sites produces a polypeptide that is more amenable to activation by the digestive processes of susceptible insects.

In this manner, mutations of the invention include mutations that are directed toward the proteolytic activation of the loop region between helix 3 and helix 4 in domain I of the Cry8-like mutants by replacing the wild type loop NGSR with other and/or additional proteolytic sites, such as chymotrypsin, trypsin, and cathepsin L and D recognition sites. To further enhance proteolysis, additional changes may be made to the loop region. For example, the mutated loop can be engineered to contain pFRRLKMFFa (SEQ ID NO: 111) where lower-case letters represent the native sequence and upper-case letters represent the engineered sequence). More than one recognition site can be added in a particular location in any combination, and multiple recognition sites can be added to or removed from the endotoxin. Thus, additional mutations can comprise three, four, or more recognition sites, for example, five cathepsin L or D motifs can be added in place of the wild type NGSR sequence (SEQ ID NO: 10) in the loop region between helices 3 and 4 of domain I.

Mutations of the invention include mutations that protect the polypeptide endotoxin from protease degradation, for example by removing putative proteolytic sites such as putative serine protease sites and cathepsin recognition sites from different areas of the endotoxin. Some or all of such putative sites may be removed or altered so that proteolysis at the location of the original site is decreased. Changes in proteolysis may be assessed by comparing a mutant endotoxin with the wild-type endotoxins or by comparing mutant endotoxins which differ in their amino acid sequence. Putative proteolytic sites include, but are not limited to, the following sequences: FRR, a cathepsin L protease cleavage site; RR, a trypsin and cathepsin B cleavage site; LKM, a chymotrypsin site; and FF, a cathepsin D site. These sites may be altered by the addition or deletion of any number and kind of amino acid residues, so long as the object of the invention is achieved, i.e., increasing the pesticidal activity of the pesticidal protein. See, e.g., Example 21, in which all three N-terminal cleavage sites for trypsin, chymotrypsin, and papain were mutated simultaneously, providing pentin-1 like proteins with improved pesticidal activity.

Cry8-like mutants K1, K2, K3, K4, K5, K6 and K8 all contain a mammalian cathepsin-sensitive proteolytic site (Filippova et al. (2000) *Bioorganicheskaya-Khimiya* 26(3): 192–196; Gacko et al. (2000) *Bulletin of the Polish Academy of Sciences Biological Sciences*, 48(1): 11–15; Pimenta et al. (2000) *Journal of Protein Chemistry* 19(5): 411–418; Melo et al. (2001) *Analytical Biochemistry* 293(1): 71–77). The mutants K1, K2, K3, K4, K5, K6 and K8 set forth in SEQ ID NOs: 39, 41, 43, 45, 47, 49, and 51, respectively, comprise the "M6 mutation" and the "164-NGSR-165 mutation" (sequence set forth in SEQ ID NO:33). The proteins encoded by these nucleic acids are set forth in SEQ ID NOs: 40, 42, 44, 46, 48, 50, and 52, respectively. Similar mutants are set forth in SEQ ID NOs: 71, 73, 75, 77, 79, 81, and 83, and comprise the "M7 mutation" and the "164-NGSR-165 mutation." The proteins encoded by these nucleic acids are set forth in SEQ ID NOs: 72, 74, 76, 78, 80, 82, and 84, respectively.

In each of the K3, K4, K5, and K6 mutants, an additional mutation was made in which one copy of a cathepsin site with motif FRSRG was added to the loop between helices 3 and 4 adjacent to either the N-terminus or the C-terminus of NGSR, a motif that exists in the 1218 Cry 8-like wild type loop region. While the invention is not bound by any theory of operation, it is thought that the addition of this site facilitates toxin activation by proteolytic cleavage of the loop.

In some of the mutants, i.e., K1, K4 and K8, a further mutation was made in which an additional proline was added to the loop region. This addition may enhance the retention of the loop structure. For example, in the K4 mutant, a proline was added immediately after the cathepsin site FRSRG (SEQ ID NO: 95). In the K8 mutant, serine (S) and leucine (L) amino acid residues were added just following the c-terminus of the cathepsin motif FRSRG. This addition is thought to expose the loop to proteases for easier digestion. Also, an additional proline was also added to the K8 mutant loop region. This addition may enhance the formation of the loop structure.

Both the K1 and K2 mutants contain a duplication of the cathepsin motif FRSRG to form FRSRGFRSRG (SEQ ID NO: 112) in the mutated loop, thus replacing the wild type NGSR amino acid residues. The K1 mutant contains an additional proline immediately after the duplicated FRSRG to favor the retention of the loop structure.

The K8 mutant comprises the FRSRG sequence in a particular relation to several other altered amino acids, so that the K8 mutant comprises the sequence FRSRGSLngsrP (SEQ ID NO: 113), in which capital letters represent amino acid changes from the native endotoxin sequence and lower case letters represent the unchanged native sequence. While the invention is not bound by any particular mechanism, it is thought that G and S residues favor loop formation; further, the addition of residues to this loop region is thought to further favor loop formation and thus enhance the sensitivity of this site to proteolytic cleavage.

The "M4, M5, M6, and M7 mutations" comprise changes to domain 3 of the protein in which valine residues are substituted for the corresponding amino acid in the wild-type sequence. In each of the "M4, M5, M6, and M7 mutations," an existing or putative chymotrypsin-preferred substrate site has been removed and replaced with a sequence comprising similar amino acids that are not recognized or preferred by chymotrypsin. Thus, in the sequence change referred to as the "M4 mutation," the wild-type sequence "ITTLNLATDSSLALKHNLGED" (SEQ ID NO: 99) is changed to "ITTLNLATDSSLALKHNVGED" (SEQ ID NO: 100). In the sequence change referred to as the "M5 mutation," this wild-type sequence is changed to "ITTLNLATDSSLAVKHNVGED" (SEQ ID NO: 101). In the sequence change referred to as the "M6 mutation," this wild-type sequence is changed to "ITTVNLATDSSVAVKHNVGED" (SEQ ID NO: 103). In the "M7 mutation," this wild-type sequence is changed to "ITTVN-LATDSSVAVKHNLGED" (SEQ ID NO: 102). The "M4, M5, M6, and M7 mutations" are set forth in the 1218-1 background sequence in combination with the "164-NGSR-165 mutation" in SEQ ID NOs: 26, 30, 34, and 71, respectively.

By "background sequence" is intended that, but for a specified change or changes in the amino acid sequence that correspond to a particular mutation or mutations, the remainder of the sequence corresponds to another native or engineered or altered sequence described herein, such as, for example, the sequences set forth in SEQ ID NOs:2, 4, 6, 8, 12, 14, or 16. Thus, in some embodiments, multiple mutations are placed into a sequence background so as to provide the resultant polypeptide with the attributes of those multiple mutations. For example, the "M6 mutation" comprising four valine substitutions may be combined with the "K0 mutation" comprising the duplicated cathepsin site sequence FRRGFRRG (SEQ ID NO: 98) to provide a Cry8-like polypeptide that resists degradation from the 3' end but is more efficiently cleaved by cathepsin in the insect gut, thereby increasing the pesticidal activity of the polypeptide. In this manner, polypeptides and nucleotides that encode polypeptides are provided that show improved properties relative to the corresponding wild-type sequences.

While the invention is not bound by any theory of operation, it is believed that alterations of the chymotrypsin site (as in Cry8-like mutants M4, M5, M6, and M7) interfere with the degradation of the toxic polypeptides from the C-terminal end, thereby enhancing the longevity of these polypeptides in the insect gut.

The nucleic acid sequences set forth in SEQ ID NOs: 53, 55, and 57 all encode polypeptides (set forth in SEQ ID NOs: 54, 56, and 58, respectively) that comprise the "K0 mutation," which is a duplication of the cathepsin site, FRRG (SEQ ID NO: 97), so that the wild-type or native amino acid sequence "npngsralr" (SEQ ID NO: 114) is replaced with the sequence "npFRRGFRRGalr" (SEQ ID NO: 116), in which capital letters represent changes from the native sequence. Each of these sequences also comprises the "M6 mutation," in which the wild-type amino acid sequence "ITTLNLATDSSLALKHNLGED" (SEQ ID NO: 99) is changed to "ITTVNLATDSSVAVKHNVGED" (SEQ ID NO: 103). Each of these sequences further comprises the "C2 mutation," which is a change designed to remove the proteolytic site near the N-terminal of the native endotoxin. In the "C2 mutation," the native amino acid sequence "dykdylkmsagn" (SEQ ID NO: 104) is replaced with the sequence "dykdyAVGsagn" (SEQ ID NO: 105).

The set of mutations found in the nucleic acid sequence of SEQ ID NO:53 and the amino acid sequence of SEQ ID NO:54 further comprise the "C3 mutation" in which the amino acid sequence is changed from the native "innyydrq" (SEQ ID NO: 106) to "innVVdrq" (SEQ ID NO: 107). This change may reduce salt bridge and electrostatic hindrances between helices which may promote channel (pore) formation by the toxin. The sets of changes found in the K34 and K35 mutants further comprise the "C4 mutation," in which the amino acid sequence is changed from the native "nydtrtypmetka" (SEQ ID NO: 108) to "nydtltypletka" (SEQ ID NO: 109). In particular, the R296I change (i.e., change from R to I at residue 296) is thought to reduce the polypeptide's susceptibility to proteolytic attack.

The invention further provides mutant polypeptides that have been constructed in various background sequences. Any background sequence may be used so long as the object of the invention is achieved, i.e., providing a pesticidal protein with increased or altered pesticidal activity. Background sequences include Cry8-like sequences disclosed herein as well as variants and fragments thereof. Background sequences may also be other Cry or Bt toxin sequences or other pesticidal polypeptides such as pentin-1, or pentin-1 like sequences. For example, mutants may be added to a native 1218-1 background sequence (SEQ ID NOs:1 and 2) or a truncated 1218-1 background sequence optimized for expression in maize (SEQ ID NOs:5 and 6). The mutant endotoxins of the invention comprise at least one amino acid change or addition relative to the native or background sequence, or 2, 3, 4, 5, 6, 7, 8, 9, 10, 11, 12, 13, 14, 15, 16, 17, 18, 19, 20, 21, 22, 23, 24, 25, 26, 27, 28, 29, 30, 32, 35, 38, 40, 45, 47, or 50 or more amino acid changes or additions. Thus, for example, the invention provides nucleotide sequences encoding mutant endotoxins comprising a second trypsin cleavage site (e.g., NGSR (SEQ ID NO:10)) introduced into the amino acid sequence presented in SEQ ID NO:12 (1218-1) or SEQ ID NO: 16 ("49PVD"). The "49PVD" fragment was generated by trimming sequence from both the N-terminus and the C-terminus of the sequence set forth in SEQ ID NO: 12. More specifically, the N-terminus of the 49PVD polypeptide was trimmed by 47 residues; thus, the polypeptide starts at aa residue 48(M) of the native polypeptide and the C-terminus was trimmed by 6 residues up to aa 663(D) of the native polypeptide. Therefore the 49PVD polypeptide corresponds to the native 1218-1 polypeptide (SEQ ID NO: 12) from aa residue 48 to aa 663 (see copending application Ser. No. 10/032,717, filed Oct. 23, 2001).

Thus, for example, SEQ ID NO:22 provides the "K0 mutation" (i.e., FRRGFRRG) as well as the "M6 mutation" in the native 1218-1 background sequence; SEQ ID NO:21 encodes the polypeptide of SEQ ID NO:22. SEQ ID NO:52 provides the "K8 mutation" (i.e., FRSRGSLngsrP) as well as the "M6 mutation" in the native 1218-1 background sequence; SEQ ID NO:52 is encoded by the nucleotide sequence set forth in SEQ ID NO:51. SEQ ID NO:68 provides the "K0 mutation" in the native 1218-1 background sequence along with the "M7 mutation," in which the wild-type amino acid sequence "ITTLNLATDSSLALKHNLGED" is changed to "ITTVNLATDSS-VAVKHNLGED," a change of 3 Leucines to Valines (see bolding). SEQ ID NO:68 is encoded by the nucleotide sequence set forth in SEQ ID NO:67.

A number of mutant sequences are provided in which the "M7 mutation" is substituted for the "M6 mutation" in a particular Cry8-like mutant sequence. Thus, SEQ ID NO:68 is the same as SEQ ID NO:22, except that the "M6 mutation" of SEQ ID NO:21 is replaced with the "M7 mutation." In the same manner, SEQ ID NOs: 70, 72, 74, 76, 78, 80, 82, 84, 86, 88, 90, 92, and 94 are the same as SEQ ID NOs: 34, 40, 42, 44, 46, 48, 50, 52, 54, 56, 58, 60, and 62, except that in each sequence the "M6 mutation" is replaced with the "M7 mutation." The amino acid sequences set forth in SEQ ID NOs: 68, 70, 72, 74, 76, 78, 80, 82, 84, 86, 88, 90, 92, and 94 are encoded by the nucleotide sequences set forth SEQ ID NOs: 67, 69, 71, 73, 75, 77, 79, 81, 83, 85, 87, 89, 91, and 93, respectively.

Accordingly, the nucleic acids of the invention comprise isolated polynucleotides, and variants and fragments thereof, that encode biologically active (e.g., pesticidal) polypeptide endotoxins, including but not limited to the nucleotide sequences set forth in SEQ ID NOs:1, 3, 5, 7, 11, 13, 15, 17, 18, 19, 21, 25, 29, 33, 39, 41, 43, 45, 47, 49, 51, 53, 55, 57, 59, 61, 63, 65, 67, 69, 71, 73, 75, 77, 79, 81, 83, 85, 87, 89, 91, and 93. The nucleotide sequences disclosed herein further provide background sequences into which mutations can be introduced, such as the sequences referred to herein as 1218-1, 1218-2, and 49PVD.

The polynucleotides of the invention also include any synthetic or recombinant nucleotide sequence that encodes a pesticidal polypeptide comprising the amino acid sequences set forth in SEQ ID NOs: 2, 4, 6, 8, 10, 12, 14, 16, 20, 22, 26, 30, 34, 40, 42, 44, 46, 48, 50, 52, 54, 56, 58, 60, 62, 64, 66, 68, 70, 72, 74, 76, 78, 80, 82, 84, 86, 88, 90, 92, 94, 119, 121, and 123.

The present invention provides isolated nucleic acids comprising nucleotide sequences which encode the amino acid sequences set forth in SEQ ID NOs: 2, 4, 6, 8, 10, 12, 14, 16, 20, 22, 26, 30, 34, 40, 42, 44, 46, 48, 50, 52, 54, 56, 58, 60, 62, 64, 66, 68, 70, 72, 74, 76, 78, 80, 82, 84, 86, 88, 90, 92, 94, 119, 121, and 123. In particular embodiments, the invention provides nucleic acids comprising the nucleotide sequences set forth in SEQ ID NOs: 1 (Cry1218-1 CDS) and 3 (Cry1218-2 CDS), the maize-optimized nucleic acid set forth in SEQ ID NO:5 (mo1218-1), and the native genomic sequences set forth in SEQ ID NO:17 (genomic Cry1218-1) and SEQ ID NO:18 (genomic Cry 1218-2). The coding sequence (CDS) for SEQ ID NO: 17 runs from base pair 731 to 4348. The CDS for SEQ ID NO: 18 runs from base pair 1254 to 4883. Plasmids comprising each of these five nucleic acids were deposited on May 5, 2000 and Oct. 20, 2000 with the Patent Depository of the American Type Culture Collection (ATCC), Manassas, Va., and assigned Patent Deposit Nos. PTA-1821 (corresponding to SEQ ID NO:1); PTA-1817 (corresponding to SEQ ID NO:3); PTA-2635 (corresponding to SEQ ID NO:5); PTA-2634 (comprising SEQ ID NO:17); and PTA-2636 (comprising SEQ ID NO: 18).

Patent Deposits PTA-1821 and PTA-1817 comprise a mixture of 2 clones, each of which contains a part of the entire coding sequence. More specifically, the deposited plasmids encode nucleic acid molecules cloned into a TA vector (Invitrogen, Carlsbad, Calif.) that encode two overlapping fragments of the coding sequence. The full length coding sequence can be produced using an overlapping PCR strategy. A first PCR reaction should comprise forward and reverse primers designed to correspond to the 5' and the 3' ends of the full-length coding sequence. The two DNA bands generated by the first PCR reaction performed with the above-identified primer sets should be purified and a second round of PCR, set for 7 cycles, should be performed utilizing the purified DNA isolated from the first PCR reaction in the absence of any primers. The 3' end of the nucleic acid generated by primer set (a) and the 5' end of the nucleic acid generated by primer set (b) will overlap and prime the generation of the full-length coding sequence. A third and final PCR reaction is performed to generate the full-length coding sequence.

The above-referenced deposits (e.g., PTA-1821; PTA-1817; PTA-2635; PTA-2634; and PTA-2636) will be maintained under the terms of the Budapest Treaty on the International Recognition of the Deposit of Microorganisms for the Purposes of Patent Procedure. These deposits were made merely as a convenience for those of skill in the art and are not an admission that a deposit is required under 35 U.S.C. §112.

Of particular interest are optimized nucleotide sequences encoding the pesticidal proteins of the invention. As used herein, the phrase "optimized nucleotide sequences" refers to nucleic acids that are optimized for expression in a particular organism, for example a plant. Optimized nucleotide sequences include those sequences that have been modified such that the GC content of the nucleotide sequence has been altered. Such a nucleotide sequence may or may not comprise a coding region. Where the nucleotide sequence comprises a coding region, the alterations of GC content may be made in view of other genetic phenomena, such as, for example, the codon preference of a particular organism or a GC content trend within a coding region. (See particularly Examples 14, 15, and 16.)

In some embodiments, where the nucleotide sequence to be optimized comprises a coding region, the alteration in GC content does not result in a change in the protein encoded by the nucleotide sequence. In other embodiments, the alteration in GC content results in changes to the encoded protein that are conservative amino acid changes and/or that do not materially alter the function of the encoded protein. The GC content of an optimized nucleotide sequence may differ from the first or native nucleotide sequence by as little as 1%, 2%, 3%, 4%, 5%, 6%, 7%, 8%, 9%, 10%, or 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, or 50% or more. Thus, the GC content of an optimized nucleotide sequence may be 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, or 80% or higher.

The term "optimized nucleotide sequences" also encompasses sequences in which the GC content has been altered and, in addition, other changes have been made to the nucleotide sequence. Such changes are often made to enhance properties of the sequence, such as its versatility in genetic engineering (e.g., by adding or removing restriction enzyme recognition sites) and any other property which may be desirable for generating a transgenic organism, such as increased mRNA longevity in the cell. (See Examples 14, 15, and 16).

By "derived from" is intended that a sequence is substantially similar to another sequence. Generally, sequences derived from a particular nucleotide sequence will have at least about 40%, 50%, 60%, 65%, 70%, 75%, 80%, 85%, 86%, 87%, 88%, 89%, 90%, 91%, 92%, 93%, 94%, 95%, 96%, 97%, 98%, 99%, or more sequence identity to that particular nucleotide sequence as determined by sequence alignment programs described elsewhere herein using default parameters. Sequences derived from a particular nucleotide sequence may differ from that sequence by as few as 1–15 nucleotides, as few as 1–10, such as 6–10, as few as 5, as few as 4, 3, 2, or even 1 nucleotide. Sequences derived from a particular nucleotide sequence may also cross-hybridize to that sequence.

Optimized nucleotide sequences may be prepared for any organism of interest using methods known in the art. For example, SEQ ID NO:5 discloses an optimized nucleic acid sequence encoding the pesticidal protein set forth in SEQ ID NO: 12 (truncated 1218-1). More specifically, the nucleotide sequence of SEQ ID NO:5 comprising maize-preferred codons was prepared by reverse-translating the amino acid sequence set forth in SEQ ID NO:12 to comprise maize-preferred codons as described by Murray et al. (1989) *Nucleic Acids Res.* 17:477–498. Optimized nucleotide sequences find use in increasing expression of a pesticidal protein in a plant, for example monocot plants of the Gramineae (Poaceae) family such as, for example, a maize or corn plant.

The invention further provides isolated pesticidal (e.g., insecticidal) polypeptides encoded by either a naturally-occurring or modified (e.g., mutagenized, truncated, and/or optimized) nucleic acid of the invention. More specifically, the invention provides polypeptides comprising an amino acid sequence set forth in SEQ ID NOs: 2, 4, 6, 8, 10, 12, 14, 16, 20, 22, 26, 30, 34, 40, 42, 44, 46, 48, 50, 52, 54, 56, 58, 60, 62, 64, 66, 68, 70, 72, 74, 76, 78, 80, 82, 84, 86, 88, 90, 92, 94, 119, 121, and 123 and the polypeptides encoded by nucleic acids described herein, for example those set forth in SEQ ID NOs: 1, 3, 5, 7, 11, 13, 15, 17, 18, 19, 21, 25, 29, 33, 39, 41, 43, 45, 47, 49, 51, 53, 55, 57, 59, 61, 63, 65, 67, 69, 71, 73, 75, 77, 79, 81, 83, 85, 87, 89, 91, 93, 118, 120, and 122 and fragments and variants thereof.

In particular embodiments, pesticidal proteins of the invention provide full-length δ-endotoxin proteins, fragments of full-length δ-endotoxins, and variant polypeptides that are produced from mutagenized nucleic acids designed to introduce particular amino acid sequences into polypeptides of the invention. In particular embodiments, the amino acid sequences that are introduced into the polypeptides comprise a sequence that provides a cleavage site for an enzyme such as a protease.

Some of the Cry8-like polypeptides of the invention, for example SEQ ID NOs: 2 and 4, comprise full-length δ-endotoxins. Other polypeptides such as SEQ ID NOs: 6, 12, and 14 embody fragments of a full-length δ-endotoxin. Some of the polypeptide fragments, variants, and mutations of the invention have enhanced pesticidal activity relative to the activity of the naturally occurring δ-endotoxin from which they are derived, particularly in the absence of in vitro activation of the endotoxin with a protease prior to screening for activity. For example, the data presented herein in Table 1 of Example 6 indicates that the NGSR addition mutant, which contains a mutation that was placed in the background sequence set forth in SEQ ID NO:12 (truncated 1218-1 endotoxin) and is referred to herein as NGSR.N1218-1 (SEQ ID NO:8), provides a polypeptide with increased pesticidal activity against Colorado potato beetle.

SEQ ID NOs: 6, 12, and 16 provide polypeptides that embody truncated versions of the 1218-1 polypeptide set forth in SEQ ID NO:2. SEQ ID NOs: 6 and 12 represent a polypeptide that is shortened (truncated) at the 3' end of the amino acid sequence set forth in SEQ ID NO:2. In contrast, the fourth polypeptide variant set forth in SEQ ID NO: 16 provides a variant that is truncated at both the 5' and 3' ends of the full-length protein set forth in SEQ ID NO:2. SEQ ID NO: 14 (1218-2) provides a polypeptide that embodies a truncated version of the polypeptide set forth in SEQ ID NO: 4. This polypeptide provides a protein that is truncated at the 3' end of the full-length 1218-2 polypeptide set forth in SEQ ID NO: 4. The mutations of the invention may be placed into any background sequence, including such truncated polypeptides, so long as an endotoxin is provided by the polypeptide so produced.

Thus, one of skill will appreciate that fragments of the disclosed proteins are also encompassed by the present invention. By "fragment" is intended a portion of the amino acid sequence of the exemplary proteins disclosed herein. Fragments of a protein may retain the pesticidal activity of the full-length protein or they may have altered or improved pesticidal activity compared to the full-length protein. Thus, fragments of a protein may range from at least about 10, 20, 30, 40, 50, 60, 70, 80, 90, 100, 110, 120, 130, 140, 150, 160, 170, 180, 190, 200, 210, 220, 230, 240, 250, 260, 270, 280, 290, 300, 320, 340, 360, 380, 400, 420, 440, 460, 480, 500, 520, 540, 560, 580, 600, 620, 640, 660, 680, 700, 720, 740, 760, 780, 800, 820, 840, 860, 880, 900, 920, 940, 960, 980, or 1000, or up to the full-length sequence of the protein. A biologically active portion, fragment, or truncated version of a pesticidal protein can be prepared by isolating a portion of one of the nucleotide sequences of the invention, expressing the encoded portion of the pesticidal protein (e.g., by recombinant expression in vitro), and assessing the activity of the portion of the pesticidal protein.

SEQ ID NOs: 8, 20, 22, 26, 30, 34, 40, 42, 44, 46, 48, 50, 52, 54, 56, 58, 60, 62, 64, 66, 68, 70, 72, 74, 76, 78, 80, 82, 84, 86, 88, 90, 92, and 94 provide a family of polypeptides that embody mutants of the biologically active Cry8-like polypeptide endotoxin set forth in SEQ ID NO:2. For example, SEQ ID NO: 8 provides the NGSR.N1218-1 mutant, which comprises an additional trypsin-sensitive cleavage site.

Thus, for example, SEQ ID NOs: 26, 30, and 34 provide exemplary mutant polypeptides of the invention. More specifically, SEQ ID NO:26, in addition to comprising the "NGSR mutation" (SEQ ID NO: 10) which is an addition of the NGSR trypsin-sensitive cleavage site, also provides the mutation that is referred to herein as "M4." SEQ ID NOs: 30 and 34, designated the "M5 mutant sequence" and the "M6 mutant sequence," respectively, provide the "NGSR mutation" in addition to the mutations referred to herein as "M5" and "M6," respectively. The nucleotide sequences set forth in SEQ ID NOs: 25, 29, and 33 encode the polypeptide sequences set forth in SEQ ID NOs: 26, 30, and 34, respectively. SEQ ID NO: 22 provides the mutant referred to herein as K04; the nucleotide sequence set forth in SEQ ID NO: 21 encodes the polypeptide sequence set forth in SEQ ID NO: 22. The K04 mutant sequence comprises the following mutations: the "K0 mutation" (in which native sequence npngsralr is changed to npFRRGFRRGalr) and the "M6 mutation" (in which native sequence ittlnlatdsslalkhnlged is changed to ittVnlatdssVaVkhnVged). SEQ ID NO:68 provides the mutant referred to herein as K03; the nucleotide sequence set forth in SEQ ID NO:67 encodes the polypeptide sequence set forth in SEQ ID NO:68. The K03 mutant sequence comprises the following mutations: the "K0 mutation" (as described above) and the "M7 mutation" (in which native sequence ittlnlatdsslalkhnlged is changed to ittVnlatdssVaVkhnlged).

In some instances, mutants disclosed herein were cloned into the pET expression system, expressed in *E. coli*, and tested for pesticidal activity against exemplary insect pests such as southern corn rootworm (SCRW), western corn rootworm (WCRW), Colorado potato beetle (CPB, e.g., *Leptinotarsa decemlineata*), and cotton boll weevil (e.g., *Anthonomus grandis*).

It is to be understood that the polypeptides of the invention can be produced either by expression of a nucleic acid disclosed herein, or by the use of standard molecular biology techniques. For example, a truncated protein of the invention can be produced by expression of a recombinant nucleic acid of the invention in an appropriate host cell, or alternatively by a combination of ex vivo procedures, such as protease digestion and purification of a purified wild-type protein.

It is recognized that the pesticidal proteins may be oligomeric and will vary in molecular weight, number of residues, component peptides, activity against particular pests, and other characteristics. However, by the methods set forth herein, proteins active against a variety of pests may be isolated and characterized. The pesticidal proteins of the invention can be used in combination with Bt endotoxins or other insecticidal proteins to increase insect target range. Furthermore, the use of the pesticidal proteins of the present invention in combination with Bt δ-endotoxins or other insecticidal principles of a distinct nature has particular utility for the prevention and/or management of insect resistance. Other insecticidal principles include, but are not limited to, protease inhibitors (both serine and cysteine types), lectins, α-amylase, and peroxidase.

Fragments and variants of the nucleotide and amino acid sequences and the polypeptides encoded thereby are also encompassed by the present invention. As used herein the term "fragment" refers to a portion of a nucleotide sequence of a polynucleotide or a portion of an amino acid sequence of a polypeptide of the invention. Fragments of a nucleotide sequence may encode protein fragments that retain the biological activity of the native or corresponding full-length protein and hence possess pesticidal activity. Thus, it is acknowledged that some of the polynucleotide and amino acid sequences of the invention can correctly be referred to as either fragments or variants. This is particularly true of truncated sequences that are biologically active.

It is to be understood that the term "fragment," as it is used to refer to nucleic acid sequences of the invention, also encompasses sequences that are useful as hybridization probes. This class of nucleotide sequences generally do not encode fragment proteins retaining biological activity. Thus, fragments of a nucleotide sequence may range from at least about 20 nucleotides, about 50 nucleotides, about 100 nucleotides, and up to the full-length nucleotide sequence encoding the proteins of the invention.

A fragment of a nucleotide sequence that encodes a biologically active portion of a pesticidal protein of the invention will encode at least 15, 25, 30, 50, 100, 200, 300, 400, 500, 600, 700, 800, 900, 1,000, 1,100, or 1,200 contiguous amino acids, or up to the total number of amino acids present in a pesticidal polypeptide of the invention (for example, 1,206, 1,210, and 669 amino acids for SEQ ID NOs:2, 4, and 6, respectively). Fragments of a nucleotide sequence that are useful as hybridization probes or PCR primers generally need not encode a biologically active portion of a pesticidal protein.

Thus, a fragment of a Cry8-like or pentin-1 like nucleic acid may encode a biologically active portion of a pesticidal protein, or it may be a fragment that can be used as a hybridization probe or PCR primer using methods disclosed below. A biologically active portion of a pesticidal protein can be prepared by isolating a portion of one of the nucleotide sequences of the invention, expressing the encoded portion of the pesticidal protein (e.g., by recombinant expression in vitro), and assessing the activity of the encoded portion of the pesticidal protein.

Nucleic acids that are fragments of a Cry8-like or pentin-1 like nucleotide sequence comprise at least 16, 20, 50, 75, 100, 150, 200, 250, 300, 350, 400, 450, 500, 600, 700, 800, 1,000, 1,200, 1,400, 1,600, 1,800, 2,000, 2,200, 2,400, 2,600, 2,800, 3,000, 3,200, 3,400, or 3,600 nucleotides, or up to the number of nucleotides present in a Cry8-like or pentin-1 like nucleotide sequence disclosed herein (for example, 3,621, 3,633, 2,010, 2010, 2022, and 2028 nucleotides for SEQ ID NOs:1, 3, 5, 11, 13, and 39 respectively).

For example, SEQ ID NOs: 5, 11, and 15 represent fragments of SEQ ID NO: 1 and SEQ ID NO:13 represents a fragment of SEQ ID NO: 3. More specifically, particular embodiments of the nucleic acids of the invention disclose fragments derived from (e.g., produced from) a first nucleic acid of the invention, wherein the fragment encodes a truncated polypeptide characterized by pesticidal activity. The truncated polypeptide encoded by the polynucleotide fragments of the invention are characterized by pesticidal activity that is either equivalent to, or improved, relative to the activity of the corresponding full-length polypeptide encoded by the first nucleic acid from which the fragment is derived.

In specific embodiments, some of the nucleic acid fragments of the invention are truncated at the 3' end of the native or corresponding full-length coding sequence. For example, SEQ ID NO: 11 represents a fragment of SEQ ID NO: 1 that is truncated at the 3' end. In an alternative embodiment, one of the polynucleotides of the invention, SEQ ID NO: 15, comprises a nucleic acid sequence that is truncated at both the 5' and 3' end of the truncated 1218-1 toxin domain encoded by SEQ ID NO: 11, respectively.

By "variants" is intended substantially similar sequences. For nucleotide sequences, conservative variants include those sequences that, because of the degeneracy of the genetic code, encode the amino acid sequence of one of the pesticidal polypeptides of the invention. Naturally occurring allelic variants such as these can be identified with the use of well-known molecular biology techniques, such as, for example, polymerase chain reaction (PCR) and hybridization techniques as outlined below.

Variant nucleotide sequences also include synthetically derived nucleotide sequences, such as those generated, for example, by using site-directed mutagenesis but which still encode a pesticidal protein of the invention, such as a mutant endotoxin. Generally, variants of a particular nucleotide sequence of the invention will have at least about 40%, 50%, 60%, 65%, 70%, 75%, 80%, 85%, 86%, 87%, 88%, 89%, 90%, 92%, 93%, 94%, 95%, 96%, 97%, 98%, 99%, or more sequence identity to that particular nucleotide sequence as determined by sequence alignment programs described elsewhere herein using default parameters. A variant of a nucleotide sequence of the invention may differ from that sequence by as few as 1–15 nucleotides, as few as 1–10, such as 6–10, as few as 5, as few as 4, 3, 2, or even 1 nucleotide.

Variants of a particular nucleotide sequence of the invention can also be evaluated by comparison of the percent sequence identity between the polypeptide encoded by a variant nucleotide sequence and the polypeptide encoded by the reference nucleotide sequence. Thus, for example, isolated nucleic acids that encode a polypeptide with a given percent sequence identity to the polypeptide of SEQ ID NO: 2 are disclosed. Percent sequence identity between any two polypeptides can be calculated using sequence alignment programs described elsewhere herein using default parameters. Where any given pair of polynucleotides of the invention is evaluated by comparison of the percent sequence identity shared by the two polypeptides they encode, the percent sequence identity between the two encoded polypeptides is at least about 40%, 45%, 50%, 55%, 60%, 65%, 70%, generally at least about 75%, 80%, 85%, preferably at least about 90%, 91%, 92%, 93%, 94%, 95%, 96%, 97%, and more preferably at least about 98%, 99% or more sequence identity.

As used herein, the term "variant protein" encompasses polypeptides that are derived from a native protein by: deletion (so-called truncation) or addition of one or more amino acids to the N-terminal and/or C-terminal end of the native protein; deletion or addition of one or more amino acids at one or more sites in the native protein; or substitution of one or more amino acids at one or more sites in the native protein. Accordingly, the term variant protein encompasses biologically active fragments of a native protein that comprise a sufficient number of contiguous amino acid residues to retain the biological activity of the native protein, i.e., to have pesticidal activity. Such pesticidal activity may be different or improved relative to the native protein or it may be unchanged, so long as pesticidal activity is retained.

Variant proteins encompassed by the present invention are biologically active, that is they continue to possess the desired biological activity of the native protein, that is, pesticidal activity as described herein. Such variants may result from, for example, genetic polymorphism or from human manipulation. Biologically active variants of a native pesticidal protein of the invention will have at least about 10%, 15%, 20%, 25%, 30%, 35%, 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99%, or more sequence identity to the amino acid sequence for the native protein as determined by sequence alignment programs described elsewhere herein using default parameters. A biologically active variant of a protein of the invention may differ from that protein by as few as 1–15 amino acid residues, as few as 1–10, such as 6–10, as few as 5, as few as 4, 3, 2, or even 1 amino acid residue.

It is recognized that the nucleic acid sequence of any one of the polynucleotides of the invention can be altered or mutagenized to alter (e.g., improve) the biological activity and/or specificity of its encoded pesticidal polypeptide. For example, SEQ ID NO: 7 represents a Cry8-like nucleotide sequence that has been mutagenized to comprise 12 additional nucleotides (SEQ ID NO: 9) that are not present in the wild-type nucleic acid sequence (SEQ ID NO: 11). In this manner, the nucleotide sequence inserted into the coding region of SEQ ID NO: 11 was designed to encode an additional trypsin cleavage site (referred to herein as the "NGSR mutation") (SEQ ID NO: 10) in the amino acid sequence of the encoded polypeptide. In the NGSR mutation, the native sequence "npngsralr" is replaced with "npNGSRngsralr" (SEQ ID NO: 115).

More specifically, the amino acid sequence set forth in SEQ ID NO: 10 was introduced between amino acid 164 and 165 of the Cry8 δ-endotoxin set forth in SEQ ID NO:12. This particular amino acid sequence was chosen because it duplicates the endogenous sequence present in the naturally occurring full-length protein (SEQ ID NO:2), and creates a second protease-sensitive site. More specifically, the modification introduces a second trypsin-like site. It is well known to those of skill in the art that trypsin cleaves bonds immediately C-terminal to arginine and lysine. As demonstrated herein the recombinantly engineered protein (SEQ ID NO:8) encoded by SEQ ID NO:7 is characterized by improved activity against *Coleopterans*, for example, against Colorado potato beetle (see Example 6, Table 1).

It is recognized that any nucleotide sequence encoding the amino acid sequences that are proteolytic sites or putative proteolytic sites (for example, sequences such as NGSR (SEQ ID NO: 10), FRRG (SEQ ID NO: 97), FRR, RR, LKM, FF, or FRSRQ (SEQ ID NO: 117)) can be used and that the exact identity of the codons used to introduce any of these cleavage sites into a variant polypeptide may vary depending on the use, i.e., expression in particular plant species. It is also recognized that any of the disclosed mutations can be introduced into any polynucleotide sequence of the invention that comprises the codons for amino acid residues that provide the native trypsin cleavage site that is targeted for modification. Accordingly, variants of either full-length pesticidal proteins or fragments thereof can be modified to contain additional or alternative cleavage sites, and these embodiments are intended to be encompassed by the scope of the invention disclosed herein.

The invention further encompasses a microorganism that is transformed with at least one nucleic acid of the invention, with an expression cassette comprising the nucleic acid, or with a vector comprising the expression cassette. Preferably, the microorganism is one that multiplies on plants. More preferably, the microorganism is a root-colonizing bacterium. An embodiment of the invention relates to an encapsulated pesticidal protein, which comprises a transformed microorganism comprising at least one pesticidal protein of the invention.

The invention provides pesticidal compositions comprising a transformed organism of the invention. Preferably the transformed microorganism is present in the pesticidal composition in a pesticidally effective amount, together with a suitable carrier. The invention also encompasses pesticidal compositions comprising an isolated protein of the invention, alone or in combination with a transformed organism of the invention and/or an encapsulated pesticidal protein of the invention, in an insecticidally effective amount, together with a suitable carrier.

The invention further provides a method of increasing insect target range by using a pesticidal protein of the invention in combination with at least one second pesticidal protein that is different from the pesticidal protein of the invention. Any pesticidal protein known in the art can be employed in the methods of the present invention. Such pesticidal proteins include, but are not limited to, Bt δ-endotoxins, protease inhibitors, lectins, α-amylases, lipid acyl hydrolases, and peroxidases.

The invention also encompasses transformed or transgenic plants comprising at least one nucleotide sequence of the invention. Preferably, the plant is stably transformed with a nucleotide construct comprising at least one nucleotide sequence of the invention operably linked to a promoter that drives expression in a plant cell. As used herein, the terms "transformed plant" and "transgenic plant" refer to a plant that comprises within its genome a heterologous polynucleotide. Generally, the heterologous polynucleotide is stably integrated within the genome of a transgenic or transformed plant such that the polynucleotide is passed on to successive generations. The heterologous polynucleotide may be integrated into the genome alone or as part of a recombinant expression cassette.

It is to be understood that as used herein the term "transgenic" includes any cell, cell line, callus, tissue, plant part, or plant the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally-occurring events such as random cross-fertilization, non-recombinant viral infection, non-recombinant bacterial transformation, non-recombinant transposition, or spontaneous mutation.

As used herein, the term "plant" includes reference to whole plants, plant organs (e.g., leaves, stems, roots, etc.), seeds, plant cells, and progeny of same. Parts of transgenic plants are to be understood within the scope of the invention to comprise, for example, plant cells, protoplasts, tissues, callus, embryos as well as flowers, ovules, stems, fruits, leaves, roots originating in transgenic plants or their progeny previously transformed with a DNA molecule of the invention and therefore consisting at least in part of transgenic cells, are also an object of the present invention.

As used herein, the term "plant cell" includes, without limitation, seeds suspension cultures, embryos, meristematic regions, callus tissue, leaves, roots, shoots, gametophytes, sporophytes, pollen, and microspores. The class of plants that can be used in the methods of the invention is generally as broad as the class of higher plants amenable to transformation techniques, including both monocotyledonous and dicotyledonous plants. Such plants include, for example, *Solanum tuberosum* and *Zea mays*.

While the invention does not depend on a particular biological mechanism for increasing the resistance of a plant to a plant pest, expression of the nucleotide sequences of the invention in a plant can result in the production of the pesticidal proteins of the invention and in an increase in the resistance of the plant to a plant pest. The plants of the invention find use in agriculture in methods for impacting insect pests. Certain embodiments of the invention provide transformed crop plants, such as, for example, maize plants, which find use in methods for impacting insect pests of the plant, such as, for example, western, northern, southern and Mexican corn rootworms. Other embodiments of the invention provide transformed potato plants, which find use in methods for impacting the Colorado potato beetle, transformed cotton plants, which find use in methods for impacting the cotton boll weevil, and transformed turf grasses, which find use in methods for impacting the bluegrass billbug, *Sphenophorous parvulus*.

One of skill in the art will readily acknowledge that advances in the field of molecular biology such as site-specific and random mutagenesis, polymerase chain reaction methodologies, and protein engineering techniques provide an extensive collection of tools and protocols suitable for use to alter or engineer both the amino acid sequence and underlying genetic sequences of proteins of agricultural interest. Thus, the pesticidal proteins of the invention may be altered in various ways including amino acid substitutions, deletions, truncations, and insertions. Methods for such manipulations are generally known in the art. For example, amino acid sequence variants of the pesticidal proteins can be prepared by introducing mutations into a synthetic nucleic acid (e.g., DNA molecule). Methods for mutagenesis and nucleic acid alterations are well known in the art. For example, designed changes can be introduced using an oligonucleotide-mediated site-directed mutagenesis technique. See, for example, Kunkel (1985) *Proc. Natl. Acad. Sci. USA* 82:488–492; Kunkel et al. (1987) *Methods in Enzymol.* 154:367–382; U.S. Pat. No. 4,873,192; Walker and Gaastra, eds. (1983) *Techniques in Molecular Biology* (Mac-Millan Publishing Company, New York), and the references cited therein.

The mutagenized nucleotide sequences of the invention may be modified so as to change about 1, 2, 3, 4, 5, 6, 8, 10, 12 or more of the amino acids present in the primary sequence of the encoded polypeptide. Alternatively even more changes from the native sequence may be introduced such that the encoded protein may have at least about 1% or 2%, or about 3%, 4%, 5%, 6%, 7%, 8%, 9%,10%,11%,12%, or even about 13%, 14%, 15%,16%,17%,18%,19%, or 20%, 21%, 22%, 23%, 24%, or 25%, 30%, 35%, or 40%, or more of the codons altered, or otherwise modified compared to the corresponding wild-type protein. In the same manner, the encoded protein may have at least about 1% or 2%, or about 3%, 4%, 5%, 6%, 7%, 8%, 9%,10%,11%,12%, or even about 13%, 14%, 15%, 16%, 17%, 18%, 19%, or 20%, 21%, 22%, 23%, 24%, or 25%, 30%, 35%, or 40% or more additional codons compared to the corresponding wild-type protein. It should be understood that the mutagenized nucleotide sequences of the present invention are intended to encompass biologically functional, equivalent peptides which have pesticidal activity, such as an improved pesticidal activity as determined by antifeedant properties against boll weevil larvae. Such sequences may arise as a consequence of codon redundancy and functional equivalency that are known to occur naturally within nucleic acid sequences and the proteins thus encoded.

One of skill in the art would recognize that amino acid additions and/or substitutions are generally based on the relative similarity of the amino acid side-chain substituents, for example, their hydrophobicity, charge, size, and the like. Exemplary substitutions that take various of the foregoing characteristics into consideration are well known to those of skill in the art and include: arginine and lysine; glutamate and aspartate; serine and threonine; glutamine and asparagine; and valine, leucine, and isoleucine.

Guidance as to appropriate amino acid substitutions that do not affect biological activity of the protein of interest may be found in the model of Dayhoff et al. (1978) *Atlas of Protein Sequence and Structure* (Natl. Biomed. Res. Found., Washington, D.C.), herein incorporated by reference. Conservative substitutions, such as exchanging one amino acid with another having similar properties, may be made.

Thus, the genes and nucleotide sequences of the invention include both the naturally occurring sequences as well as mutant forms. Likewise, the proteins of the invention encompass both naturally occurring proteins as well as variations (e.g., truncated polypeptides) and modified (e.g., mutant) forms thereof. Such variants will continue to possess the desired pesticidal activity. Obviously, the mutations that will be made in the DNA encoding the variant must not place the sequence out of reading frame and preferably will not create complementary regions that could produce secondary mRNA structure. See, EP Patent Application Publication No. 75,444.

The deletions, insertions, and substitutions of the protein sequences encompassed herein are not expected to produce radical changes in the characteristics of the protein. However, when it is difficult to predict the exact effect of the substitution, deletion, or insertion in advance of doing so, one skilled in the art will appreciate that the effect will be evaluated by routine screening assays, such as insect-feeding assays. See, for example, Marrone et al. (1985) *J. Econ. Entomol.* 78:290–293 and Czapla and Lang (1990) *J. Econ. Entomol.* 83:2480–2485, herein incorporated by reference.

Variant nucleotide sequences and proteins also encompass sequences and proteins derived from a mutagenic and recombinogenic procedure such as DNA shuffling. With such a procedure, one or more different coding sequences can be manipulated to create a new pesticidal protein possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, full-length coding sequences, sequence motifs encoding a domain of interest, or any fragment of a nucleotide sequences of the invention may be shuffled between the nucleotide sequences encoding the pesticidal proteins of the invention and corresponding portions of other nucleotide sequences known to encode pesticidal proteins to obtain a new gene coding for a protein with an improved property of interest.

Properties of interest include, but are not limited to, pesticidal activity per unit of pesticidal protein, protein stability, and toxicity to non-target species particularly humans, livestock, and plants and microbes that express the pesticidal polypeptides of the invention. The invention is not bound by a particular shuffling strategy, only that at least one nucleotide sequence of the invention, or part thereof, is involved in such a shuffling strategy. Shuffling may involve only nucleotide sequences disclosed herein or may additionally involve shuffling of any other nucleotide sequences known in the art including, but not limited to, GenBank Accession Nos. U04364, U04365, and U04366. Strategies for DNA shuffling are known in the art. See, for example, Stemmer (1994) *Proc. Natl. Acad. Sci.* USA 91:10747–10751; Stemmer (1994) *Nature* 370:389–391; Crameri et al. (1997) *Nature Biotech.* 15:436–438; Moore et al. (1997) *J. Mol. Biol.* 272:336–347; Zhang et al. (1997) *Proc. Natl. Acad. Sci.* USA 94:4504–4509; Crameri et al. (1998) *Nature* 391:288–291; and U.S. Pat. Nos. 5,605,793 and 5,837,458.

The nucleotide sequences of the invention can also be used to isolate corresponding sequences from other organisms, particularly other bacteria, and more particularly other *Bacillus* strains. In this manner, methods such as PCR, hybridization, and the like can be used to identify such sequences based on their sequence homology to the sequences set forth herein. Sequences isolated based on their sequence identity to the entire Cry8-like sequences set forth herein or to fragments thereof are encompassed by the present invention. Such sequences include sequences that are orthologs of the disclosed sequences. By "orthologs" is intended genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

In a PCR approach, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook et al. (1989) *Molecular Cloning: A Laboratory Manual* (2d ed., Cold Spring Harbor Laboratory Press, Plainview, N.Y.). See also Innis et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

In hybridization techniques, all or part of a known nucleotide sequence is used as a probe that selectively hybridizes to other corresponding nucleotide sequences present in a population of cloned genomic DNA fragments or cDNA fragments (i.e., genomic or cDNA libraries) from a chosen organism. The hybridization probes may be genomic DNA fragments, cDNA fragments, RNA fragments, or other oligonucleotides, and may be labeled with a detectable group such as $^{32}P$, or any other detectable marker. Thus, for example, probes for hybridization can be made by labeling synthetic oligonucleotides based on the nucleotide sequences of the invention. Methods for preparation of probes for hybridization and for construction of cDNA and genomic libraries are generally known in the art and are disclosed in Sambrook et al. (1989) *Molecular Cloning: A Laboratory Manual* (2d ed., Cold Spring Harbor Laboratory Press, Plainview, N.Y.).

For example, an entire Cry8-like sequence disclosed herein, or one or more portions thereof, may be used as a probe capable of specifically hybridizing to corresponding Cry8-like sequences and messenger RNAs. To achieve specific hybridization under a variety of conditions, such probes include sequences that are unique among Cry8-like sequences and are preferably at least about 10 nucleotides in length, and most preferably at least about 20 nucleotides in length. Such probes may be used to amplify corresponding Cry8-like sequences from a chosen organism by PCR. This technique may be used to isolate additional coding sequences from a desired organism or as a diagnostic assay to determine the presence of coding sequences in a an organism. Hybridization techniques include hybridization screening of plated DNA libraries (either plaques or colonies; see, for example, Sambrook et al. (1989) *Molecular Cloning: A Laboratory Manual* (2d ed., Cold Spring Harbor Laboratory Press, Plainview, N.Y.).

Hybridization of such sequences may be carried out under stringent conditions. By "stringent conditions" or "stringent hybridization conditions" is intended conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 nucleotides in length, preferably less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulfate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1× SSC at 60 to 65° C. The duration of hybridization is generally less than about 24 hours, usually about 4 to about 12 hours.

Specificity is typically the function of post-hybridization washes, the critical factors being the ionic strength and temperature of the final wash solution. For DNA-DNA hybrids, the $T_m$ can be approximated from the equation of Meinkoth and Wahl (1984) *Anal. Biochem.* 138:267–284: $T_m$=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization, and/or wash conditions can be adjusted to hybridize to sequences of the desired identity. For example, if sequences with ≧90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution), it is preferred to increase the SSC concentration so that a higher temperature can be used. An extensive guide to the hybridization of nucleic acids is found in Tijssen (1993) *Laboratory Techniques in Biochemistry and Molecular Biology—Hybridization with Nucleic Acid Probes*, Part I, Chapter 2 (Elsevier, N.Y.); and Ausubel et al., eds. (1995) *Current Protocols in Molecular Biology*, Chapter 2 (Greene Publishing and Wiley-Interscience, New York). See Sambrook et al. (1989) *Molecular Cloning: A Laboratory Manual* (2d ed., Cold Spring Harbor Laboratory Press, Plainview, N.Y.). Thus, for example, isolated sequences that encode a Cry8-like protein of the invention and hybridize under stringent conditions to the Cry8-like sequences disclosed herein, or to fragments thereof, are encompassed by the present invention.

The following terms are used to describe the sequence relationships between two or more nucleic acids or polynucleotides: (a) "reference sequence," (b) "comparison window," (c) "sequence identity," (d) "percentage of sequence identity," and (e) "substantial identity."

(a) As used herein, "reference sequence" is a defined sequence used as a basis for sequence comparison. A reference sequence may be a subset or the entirety of a specified sequence; for example, as a segment of a full-length cDNA or gene sequence, or the complete cDNA or gene sequence.

(b) As used herein, "comparison window" makes reference to a contiguous and specified segment of a polynucleotide sequence, wherein the polynucleotide sequence in the comparison window may comprise additions or deletions (i.e., gaps) compared to the reference sequence (which does not comprise additions or deletions) for optimal alignment of the two sequences. Generally, the comparison window is at least 20 contiguous nucleotides in length, and optionally can be 30, 40, 50, 100, or longer. Those of skill in the art understand that to avoid a high similarity to a reference sequence due to inclusion of gaps in the polynucleotide sequence a gap penalty is typically introduced and is subtracted from the number of matches.

Methods of alignment of sequences for comparison are well known in the art. Thus, the determination of percent identity between any two sequences can be accomplished using a mathematical algorithm. Non-limiting examples of such mathematical algorithms are the algorithm of Myers and Miller (1988) *CABIOS* 4:11–17; the local homology algorithm of Smith et al. (1981) *Adv. Appl. Math.* 2:482; the homology alignment algorithm of Needleman and Wunsch (1970) *J. Mol. Biol.* 48:443–453; the search-for-similarity-method of Pearson and Lipman (1988) *Proc. Natl. Acad. Sci.* 85:2444–2448; the algorithm of Karlin and Altschul (1990) *Proc. Natl. Acad. Sci. USA* 87:2264, modified as in Karlin and Altschul (1993) *Proc. Natl. Acad. Sci. USA* 90:5873–5877.

Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0); the ALIGN PLUS program (Version 3.0, copyright 1997); and GAP, BESTFIT, BLAST, FASTA, and TFASTA in the Wisconsin Genetics Software Package of Genetics Computer Group, Version 10 (available from Accelrys, 9685 Scranton Road, San Diego, Calif., 92121, USA). The scoring matrix used in Version 10 of the Wisconsin Genetics Software Package is BLOSUM62 (see Henikoff and Henikoff (1989) *Proc. Natl. Acad. Sci. USA* 89:10915).

Alignments using these programs can be performed using the default parameters. The CLUSTAL program is well described by Higgins et al. (1988) *Gene* 73:237–244 (1988); Higgins et al. (1989) *CABIOS* 5:151–153; Corpet et al. (1988) *Nucleic Acids Res.* 16:10881–90; Huang et al. (1992) *CABIOS* 8:155–65; and Pearson et al. (1994) *Meth. Mol. Biol.* 24:307–331. The ALIGN and the ALIGN PLUS programs are based on the algorithm of Myers and Miller (1988) supra. A PAM120 weight residue table, a gap length penalty of 12, and a gap penalty of 4 can be used with the ALIGN program when comparing amino acid sequences. The BLAST programs of Altschul et al (1990) *J. Mol. Biol.* 215:403 are based on the algorithm of Karlin and Altschul (1990) supra. BLAST nucleotide searches can be performed with the BLASTN program, score=100, word length=12, to obtain nucleotide sequences homologous to a nucleotide sequence encoding a protein of the invention. BLAST protein searches can be performed with the BLASTX program, score=50, wordlength=3, to obtain amino acid sequences homologous to a protein or polypeptide of the invention. To obtain gapped alignments for comparison purposes, Gapped BLAST (in BLAST 2.0) can be utilized as described in Altschul et al. (1997) *Nucleic Acids Res.* 25:3389. Alternatively, PSI-BLAST (in BLAST 2.0) can be used to perform an iterated search that detects distant relationships between molecules. See Altschul et al. (1997) supra. When utilizing BLAST, Gapped BLAST, or PSI-BLAST, the default parameters of the respective programs (e.g., BLASTN for nucleotide sequences, BLASTX for proteins) can be used. On the world wide web see ncbi.hlm-.nih.gov. Alignment may also be performed manually by inspection.

Unless otherwise stated, nucleotide and amino acid sequence identity/similarity values provided herein refer to the value obtained using GAP with default parameters, or any equivalent program. By "equivalent program" is intended any sequence comparison program that, for any two sequences in question, generates an alignment having identical nucleotide or amino acid residue matches and an identical percent sequence identity when compared to the corresponding alignment generated by the preferred program.

GAP uses the algorithm of Needleman and Wunsch (1970) *J. Mol. Biol.* 48:443–453, to find the alignment of two complete sequences that maximizes the number of matches and minimizes the number of gaps. GAP considers all possible alignments and gap positions and creates the alignment with the largest number of matched bases and the fewest gaps. It allows for the provision of a gap creation penalty and a gap extension penalty in units of matched bases. GAP must make a profit of gap creation penalty number of matches for each gap it inserts. If a gap extension penalty greater than zero is chosen, GAP must, in addition, make a profit for each gap inserted of the length of the gap times the gap extension penalty. Default gap creation penalty values and gap extension penalty values in Version 10 of the Wisconsin Genetics Software Package for protein sequences are 8 and 2, respectively. For nucleotide sequences, the default gap creation penalty is 50 while the default gap extension penalty is 3. The gap creation and gap extension penalties can be expressed as an integer selected from the group of integers consisting of from 0 to 200. Thus, for example, the gap creation and gap extension penalties can each be 0, 1, 2, 3, 4, 5, 6, 7, 8, 9, 10, 15, 20, 25, 30, 35, 40, 45, 50, 55, 60, 65 or greater.

For purposes of the present invention, comparison of nucleotide or protein sequences for determination of percent sequence identity to the Cry8-like sequences disclosed herein is preferably made using the GAP program in the Wisconsin Genetics Software Package (Version 10 or later) or any equivalent program. For GAP analyses of nucleotide sequences, a GAP Weight of 50 and a Length of 3 was used.

(c) As used herein, "sequence identity" or "identity" in the context of two nucleic acid or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity." Means for making this adjustment are well known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, Calif.).

(d) As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

(e)(i) The term "substantial identity" of polynucleotide sequences means that a polynucleotide comprises a sequence that has at least 70% sequence identity, preferably at least 80%, more preferably at least 90%, and most preferably at least 95%, compared to a reference sequence using one of the alignment programs described using standard parameters. One of skill in the art will recognize that these values can be appropriately adjusted to determine corresponding identity of proteins encoded by two nucleotide sequences by taking into account codon degeneracy, amino acid similarity, reading frame positioning, and the like. Substantial identity of amino acid sequences for these purposes normally means sequence identity of at least 60%, more preferably at least 70%, 80%, 90%, and most preferably at least 95%.

Another indication that nucleotide sequences are substantially identical is if two molecules hybridize to each other under stringent conditions. Generally, stringent conditions are selected to be about 5° C. lower than the thermal melting point ($T_m$) for the specific sequence at a defined ionic strength and pH. However, stringent conditions encompass temperatures in the range of about 1° C. to about 20° C., depending upon the desired degree of stringency as otherwise qualified herein. Nucleic acids that do not hybridize to each other under stringent conditions are still substantially identical if the polypeptides they encode are substantially identical. This may occur, e.g., when a copy of a nucleic acid is created using the maximum codon degeneracy permitted by the genetic code. One indication that two nucleic acid sequences are substantially identical is when the polypeptide encoded by the first nucleic acid is immunologically cross reactive with the polypeptide encoded by the second nucleic acid.

(e)(ii) The term "substantial identity" in the context of a peptide indicates that a peptide comprises a sequence with at least 70% sequence identity to a reference sequence, preferably 80%, more preferably 85%, most preferably at least 90% or 95% sequence identity to the reference sequence over a specified comparison window. Preferably, optimal alignment is conducted using the homology alignment algorithm of Needleman and Wunsch (1970) *J. Mol. Biol.* 48:443–453. An indication that two peptide sequences are substantially identical is that one peptide is immunologically reactive with antibodies raised against the second peptide. Thus, a peptide is substantially identical to a second peptide, for example, where the two peptides differ only by a conservative substitution. Peptides that are "substantially similar" share sequences as noted above except that residue positions that are not identical may differ by conservative amino acid changes.

The use of the term "nucleotide constructs" herein is not intended to limit the present invention to nucleotide constructs comprising DNA. Those of ordinary skill in the art will recognize that nucleotide constructs, particularly polynucleotides and oligonucleotides composed of ribonucleotides and combinations of ribonucleotides and deoxyribonucleotides, may also be employed in the methods disclosed herein. The nucleotide constructs, nucleic acids, and nucleotide sequences of the invention additionally encompass all complementary forms of such constructs, molecules, and sequences. Further, the nucleotide constructs, nucleotide molecules, and nucleotide sequences of the present invention encompass all nucleotide constructs, molecules, and sequences which can be employed in the methods of the present invention for transforming plants including, but not limited to, those comprised of deoxyribonucleotides, ribonucleotides, and combinations thereof. Such deoxyribonucleotides and ribonucleotides include both naturally occurring molecules and synthetic analogues. The nucleotide constructs, nucleic acids, and nucleotide sequences of the invention also encompass all forms of nucleotide constructs including, but not limited to, single-stranded forms, double-stranded forms, hairpins, stem-and-loop structures, and the like.

A further embodiment of the invention relates to a transformed organism such as an organism selected from the group consisting of plant and insect cells, bacteria, yeast, baculoviruses, protozoa, nematodes, and algae. The transformed organism comprises: a DNA molecule of the invention, an expression cassette comprising the said DNA molecule, or a vector comprising the said expression cassette, preferably stably incorporated into the genome of the transformed organism.

The sequences of the invention are provided in expression cassettes for expression in the organism of interest. The cassette will include 5' and 3' regulatory sequences operably linked to a sequence of the invention. By "operably linked" is intended a functional linkage between a promoter and a second sequence, wherein the promoter sequence initiates and mediates transcription of the DNA sequence corresponding to the second sequence. Generally, operably linked means that the nucleic acid sequences being linked are contiguous and, where necessary to join two protein coding regions, contiguous and in the same reading frame. The cassette may additionally contain at least one additional gene to be cotransformed into the organism. Alternatively, the additional gene(s) can be provided on multiple expression cassettes.

Such an expression cassette is provided with a plurality of restriction sites for insertion of the sequence to be under the transcriptional regulation of the regulatory regions. The expression cassette may additionally contain selectable marker genes.

The expression cassette will include in the 5' to 3' direction of transcription: a transcriptional and translational initiation region, a DNA sequence of the invention, and a transcriptional and translational termination region functional in the organism serving as a host. The transcriptional initiation region (i.e., the promoter) may be native or analogous or foreign or heterologous to the host organism. Additionally, the promoter may be the natural sequence or alternatively a synthetic sequence. By "foreign" is intended that the transcriptional initiation region is not found in the native organism into which the transcriptional initiation region is introduced. As used herein, a chimeric gene comprises a coding sequence operably linked to a transcription initiation region that is heterologous to the coding sequence. Where the promoter is a native or natural sequence, the expression of the operably linked sequence is altered from the wild-type expression, which results in an alteration in phenotype.

The termination region may be native with the transcriptional initiation region, may be native with the operably linked DNA sequence of interest, or may be derived from another source. Convenient termination regions are available from the Ti-plasmid of *A. tumefaciens*, such as the octopine synthase and nopaline synthase termination regions. See also Guerineau et al. (1991) *Mol. Gen. Genet.* 262:141–144; Proudfoot (1991) *Cell* 64:671–674; Sanfacon et al. (1991) *Genes Dev.* 5:141–149; Mogen et al. (1990) *Plant Cell* 2:1261–1272; Munroe et al. (1990) *Gene* 91:151–158; Ballas et al. (1989) *Nucleic Acids Res.* 17:7891–7903; and Joshi et al. (1987) *Nucleic Acid Res.* 15:9627–9639.

Where appropriate, a nucleic acid may be optimized for increased expression in the host organism. Thus, where the host organism is a plant, a sequence may be optimized using plant-preferred codons for improved expression. See, for example, Campbell and Gowri (1990) *Plant Physiol.* 92:1–11 for a discussion of host-preferred codon usage. For example, although nucleic acid sequences of the present invention may be expressed in both monocotyledonous and dicotyledonous plant species, sequences can be modified to account for the specific codon preferences and GC content preferences of monocotyledons or dicotyledons as these preferences have been shown to differ (Murray et al. (1989) *Nucleic Acids Res.* 17:477–498). Thus, the maize-preferred codon for a particular amino acid may be derived from known gene sequences from maize. Maize codon usage for 28 genes from maize plants are listed in Table 4 of Murray et al., supra. Methods are available in the art for synthesizing plant-preferred genes. See, for example, U.S. Pat. Nos. 5,380,831, and 5,436,391, and Murray et al. (1989) *Nucleic Acids Res.* 17:477–498, herein incorporated by reference.

In addition to altering codons of a sequence in accordance with an organism's codon preference, optimization of a sequence can include modification of the GC content of the sequence. Gene GC content is a common metric of gene structure. GC content can vary greatly within and between genes, and between genes of the same or different organisms. The reasons for this variation are not definitively known, but may include factors such as chromosome organization and function, methylation pressure, presence of repetitive DNA, adaptations for gene expression, and codon-anticodon coadapted biases. Most organisms have gene populations that display a fairly normal GC content distribution, but some warm-blooded vertebrates as well as cereal plants, including maize, have a curious bimodal distribution of GC content (e.g. Campbell and Gowri (1990), supra; Bernardi (1995) *Annual Review of Genetics* 29:445–475; Carels and Bernardi (2000) *Genetics* 154:1819–1825). The biological significance of this bimodality remains unknown, but observations concerning GC content distributions and bimodal tendencies are mounting, especially with the completion of genome sequencing, for example, in humans and in rice (International Human Genome Sequencing Consortium (2001) *Nature* 409:860–921; Yu et al. (2002) *Science* 296:79–91; Wong et al. (2002) *Genome Research* 12:851–856).

Maize and other cereals have distinctly bimodal gene GC content distributions not observed in other taxonomic groups such as dicot plants, animals, fungi, bacteria, and archaea. Using the largest maize gene dataset to date, we explored differences in mRNA structure and expression between the high and low GC modes. The bimodality phenomenon is observed in nuclear-encoded genes. In maize, the two modes occur at approximately 51% and 67% GC content (which may be referred to as "low (GC) mode" and "high (GC) mode.") Most maize genes are "low mode" and have GC content at the lower level of approximately 51%. Most GC content variation is found in the coding region, particularly in the third codon position. GC content in the third codon position can reach 100%, and in high GC mode genes, C can predominate over G by a ratio of 1:3.

Analysis of GC content also reveals patterns within genes, particularly within the coding region (also called the "ORF," or Open Reading Frame). For example, if GC content is evaluated along the coding region of a gene, maize genes have a generally negative GC gradient (i.e., GC content decreases toward the 3' end of the coding region). However, this gradient pattern is not present in most high GC mode genes and about half of the low GC mode genes. Further, the coding regions of the remaining low GC mode genes (i.e., the other half) shows a reversal of the marked negative GC gradient into a positive gradient towards the end of the coding region.

Another GC content pattern observed in maize is that high GC mode genes are richer in GC-rich codon amino acids, and this variation also occurs in a gradient along the length of the coding sequence. For example, in high GC mode genes, the amino acid bias for alanine is greatest near the beginning of the coding sequence. While gene expression varies widely, we have determined that the overall average expression of high and low GC mode genes is similar as revealed by both EST and Lynx MPSS mRNA profiling (see Brenner et al. (2000) *Nature Biotechnology* 18: 630–634; Brenner et al. (2000) *PNAS* 97: 1665–1670 for information on Lynx MPSS; see Simmons et al., Maize Coop Newsletter 2002, on the world wide web at Agron.Missouri. edu/mnl/77 /10simmons.html for comment on high and low GC mode gene expression). However, high GC mode genes were observed to show higher tissue-preferred expression, especially in vegetative and non-kernel reproductive tissues, while low GC mode genes showed higher expression levels in endosperm, pericarp and R1 kernel tissues.

Additional sequence modifications are known to enhance gene expression in a cellular host. These include elimination of sequences encoding spurious polyadenylation signals, exon-intron splice site signals, transposon-like repeats, and other well-characterized sequences that may be deleterious to gene expression. Also, as described herein, particularly in Examples 14, 15, and 16, the GC content of the sequence may be adjusted to levels average for a given cellular host, as calculated by reference to known genes expressed in the host cell. By "host cell" is meant a cell that contains a vector and supports the replication and/or expression of the expression vector. A host organism is an organism that contains a host cell. Host cells may be prokaryotic cells such as *E. coli*, or eukaryotic cells such as yeast, insect, amphibian, or mammalian cells. Preferably, host cells are monocotyledonous or dicotyledonous plant cells. A particularly preferred monocotyledonous host cell is a maize host cell. When possible, the sequence is modified to avoid predicted hairpin secondary mRNA structures.

The expression cassettes may additionally contain 5' leader sequences in the expression cassette construct. Such leader sequences can act to enhance translation. Translation leaders are known in the art and include: picornavirus leaders, for example, EMCV leader (Encephalomyocarditis 5' noncoding region) (Elroy-Stein et al. (1989) *Proc. Natl. Acad. Sci. USA* 86: 6126–6130); potyvirus leaders, for example, TEV leader (Tobacco Etch Virus) (Gallie et al. (1995) *Gene* 165(2): 233–238), MDMV leader (Maize Dwarf Mosaic Virus) (*Virology* 154:9–20), and human immunoglobulin heavy-chain binding protein (BiP) (Macejak et al. (1991) *Nature* 353: 90–94); untranslated leader from the coat protein mRNA of alfalfa mosaic virus (AMV RNA 4) (Jobling et al. (1987) *Nature* 325: 622–625); tobacco mosaic virus leader (TMV) (Gallie et al. (1989) in *Molecular Biology of RNA*, ed. Cech (Liss, New York), pp. 237–256); and maize chlorotic mottle virus leader (MCMV) (Lommel et al. (1991) *Virology* 81: 382–385). See also, Della-Cioppa et al. (1987) *Plant Physiol.* 84: 965–968. Other methods known to enhance translation can also be utilized, for example, introns and the like.

In preparing the expression cassette, the various DNA fragments may be manipulated so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

A number of promoters can be used in the practice of the invention. The promoters can be selected based on the desired outcome. The nucleic acids can be combined with constitutive, tissue-preferred, inducible, or other promoters for expression in the host organism. Suitable constitutive promoters for use in a plant host cell include, for example, the core promoter of the Rsyn7 promoter and other constitutive promoters disclosed in WO 99/43838 and U.S. Pat. No. 6,072,050; the core CaMV 35S promoter (Odell et al. (1985) *Nature* 313:810–812); rice actin (McElroy et al. (1990) *Plant Cell* 2:163–171); ubiquitin (Christensen et al. (1989) *Plant Mol. Biol.* 12:619–632 and Christensen et al. (1992) *Plant Mol. Biol.* 18:675–689); pEMU (Last et al. (1991) *Theor. Appl. Genet.* 81:581–588); MAS (Velten et al. (1984) *EMBO J.* 3:2723–2730); ALS promoter (U.S. Pat. No. 5,659,026), and the like. Other constitutive promoters include, for example, those discussed in U.S. Pat. Nos. 5,608,149; 5,608,144; 5,604,121; 5,569,597; 5,466,785; 5,399,680; 5,268,463; 5,608,142; and 6,177,611.

Depending on the desired outcome, it may be beneficial to express the gene from an inducible promoter. Of particular interest for regulating the expression of the nucleotide sequences of the present invention in plants are wound-inducible promoters. Such wound-inducible promoters, may respond to damage caused by insect feeding, and include potato proteinase inhibitor (pin II) gene (Ryan (1990) *Ann. Rev. Phytopath.* 28: 425–449; Duan et al. (1996) *Nature Biotechnology* 14: 494–498); wun1 and wun2, U.S. Pat. No. 5,428,148; win1 and win2 (Stanford et al. (1989) *Mol. Gen. Genet.* 215: 200–208); systemin (McGurl et al. (1992) *Science* 225: 1570–1573); WIP1 (Rohmeier et al. (1993) *Plant Mol. Biol.* 22: 783–792; Eckelkamp et al. (1993) *FEBS Letters* 323: 73–76); MPI gene (Corderok et al. (1994) *Plant J.* 6(2): 141–150); and the like, herein incorporated by reference.

Additionally, pathogen-inducible promoters may be employed in the methods and nucleotide constructs of the present invention. Such pathogen-inducible promoters include those from pathogenesis-related proteins (PR proteins), which are induced following infection by a pathogen; e.g., PR proteins, SAR proteins, beta-1,3-glucanase, chitinase, etc. See, for example, Redolfi et al. (1983) *Neth. J. Plant Pathol.* 89: 245–254; Uknes et al. (1992) *Plant Cell* 4:645–656; and Van Loon (1985) *Plant Mol. Virol.* 4:111–116. See also WO 99/43819, herein incorporated by reference.

Of interest are promoters that are expressed locally at or near the site of pathogen infection. See, for example, Marineau et al. (1987) *Plant Mol. Biol.* 9:335–342; Matton et al. (1989) *Molecular Plant-Microbe Interactions* 2:325–331; Somsisch et al. (1986) *Proc. Natl. Acad. Sci. USA* 83:2427–2430; Somsisch et al. (1988) *Mol. Gen. Genet.* 2:93–98; and Yang (1996) *Proc. Natl. Acad. Sci. USA* 93:14972–14977. See also, Chen et al. (1996) *Plant J.* 10:955–966; Zhang et al. (1994) *Proc. Natl. Acad. Sci. USA* 91:2507–2511; Warner et al. (1993) *Plant J.* 3:191–201; Siebertz et al. (1989) *Plant Cell* 1:961–968; U.S. Pat. No. 5,750,386 (nematode-inducible); and the references cited therein. Of particular interest is the inducible promoter for the maize PRms gene, whose expression is induced by the pathogen *Fusarium moniliforme* (see, for example, Cordero et al. (1992) *Physiol. Mol. Plant Path.* 41:189–200).

Chemical-regulated promoters can be used to modulate the expression of a gene in a plant through the application of an exogenous chemical regulator. Depending upon the objective, the promoter may be a chemical-inducible promoter, where application of the chemical induces gene expression, or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena et al. (1991) *Proc. Natl. Acad. Sci. USA* 88:10421–10425 and McNellis et al. (1998) *Plant J.* 14(2):247–257) and tetracycline-inducible and tetracycline-repressible promoters (see, for example, Gatz et al. (1991) *Mol. Gen. Genet.* 227:229–237, and U.S. Pat. Nos. 5,814,618 and 5,789,156), herein incorporated by reference.

Tissue-preferred promoters can be utilized to target enhanced pesticidal protein expression within a particular plant tissue. Tissue-preferred promoters include those discussed in Yamamoto et al. (1997) *Plant J.* 12(2)255–265; Kawamata et al. (1997) *Plant Cell Physiol.* 38(7):792–803; Hansen et al. (1997) *Mol. Gen Genet.* 254(3):337–343; Russell et al. (1997) *Transgenic Res.* 6(2): 157–168; Rinehart et al. (1996) *Plant Physiol.* 112(3): 1331–1341; Van Camp et al. (1996) *Plant Physiol.* 112(2):525–535; Canevascini et al. (1996) *Plant Physiol.* 112(2):513–524; Yamamoto et al. (1994) *Plant Cell Physiol.* 35(5):773–778; Lam (1994) *Results Probl. Cell Differ.* 20:181–196; Orozco et al. (1993) *Plant Mol Biol.* 23(6):1129–1138; Matsuoka et al. (1993) *Proc Natl. Acad. Sci. USA* 90(20):9586–9590; and Guevara-Garcia et al. (1993) *Plant J.* 4(3):495–505. Such promoters can be modified, if necessary, for weak expression.

Leaf-specific promoters are known in the art. See, for example, Yamamoto et al. (1997) *Plant J.* 12(2):255–265; Kwon et al. (1994) *Plant Physiol.* 105:357–67; Yamamoto et al. (1994) *Plant Cell Physiol.* 35(5):773–778; Gotor et al. (1993) *Plant J.* 3:509–18; Orozco et al. (1993) *Plant Mol. Biol.* 23(6):1129–1138; and Matsuoka et al. (1993) *Proc. Natl. Acad. Sci. USA* 90(20):9586–9590.

Root-specific promoters are known and can be selected from those available from the literature or isolated de novo from various compatible species. See, for example, Hire et al. (1992) *Plant Mol. Biol.* 20(2):207–218 (soybean root-specific glutamine synthetase gene); Keller and Baumgartner (1991) *Plant Cell* 3(10):1051–1061 (root-specific control element in the GRP 1.8 gene of French bean); Sanger et al. (1990) *Plant Mol. Biol.* 14(3):433–443 (root-specific promoter of the mannopine synthase (MAS) gene of *Agrobacterium tumefaciens*); and Miao et al. (1991) *Plant Cell* 3(1):11–22 (full-length cDNA clone encoding cytosolic glutamine synthetase (GS), which is expressed in roots and root nodules of soybean). See also Bogusz et al. (1990) *Plant Cell* 2(7):633–641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a β-glucuronidase reporter gene and introduced into both the nonlegume *Nicotiana tabacum* and the legume *Lotus corniculatus*, and in both instances root-specific promoter activity was preserved. Leach and Aoyagi (1991) describe their analysis of the promoters of the highly expressed rolC and rolD root-inducing genes of *Agrobacterium rhizogenes* (see *Plant Science* (Limerick) 79(1):69–76). They concluded that enhancer and tissue-preferred DNA determinants are dissociated in those promoters. Teeri et al. (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see *EMBO J* 8(2): 343–350). The TR1' gene fused to nptII(neomycin phosphotransferase II) showed similar characteristics. Additional root-preferred promoters include the VfENOD-GRP3 gene promoter (Kuster et al. (1995) *Plant Mol. Biol.* 29(4): 759–772); and rolB promoter (Capana et al. (1994) *Plant Mol. Biol.* 25(4):681–691. See also U.S. Pat. Nos. 5,837,876; 5,750,386; 5,633,363; 5,459,252; 5,401,836; 5,110,732; and 5,023,179.

"Seed-preferred" promoters include both "seed-specific" promoters (those promoters active during seed development such as promoters of seed storage proteins) as well as "seed-germinating" promoters (those promoters active during seed germination). See Thompson et al. (1989) *BioEssays* 10:108, herein incorporated by reference. Such seed-preferred promoters include, but are not limited to, Cim1 (cytokinin-induced message); cZ19B1 (maize 19 kDa zein); and milps (myo-inositol-1-phosphate synthase); (see WO 00/11177 and U.S. Pat. No. 6,225,529, herein incorporated by reference). Gamma-zein is a preferred endosperm-specific promoter. Glob-1 is a preferred embryo-specific promoter. For dicots, seed-specific promoters include, but are not limited to, bean β-phaseolin, napin, β-conglycinin, soybean lectin, cruciferin, and the like. For monocots, seed-specific promoters include, but are not limited to, maize 15 kDa zein, 22 kDa zein, 27 kDa zein, g-zein, waxy, shrunken 1, shrunken 2, globulin 1, etc. See also WO 00/12733, where seed-preferred promoters from end1 and end2 genes are disclosed; herein incorporated by reference. A promoter that has "preferred" expression in a particular tissue is expressed in that tissue to a greater degree than in at least one other plant tissue. Some tissue-preferred promoters show expression almost exclusively in the particular tissue.

Where low level expression is desired, weak promoters will be used. Generally, by "weak promoter" is intended a promoter that drives expression of a coding sequence at a low level. By low level is intended at levels of about $1/1000$ transcripts to about $1/100,000$ transcripts to about $1/500,000$ transcripts. Alternatively, it is recognized that the term "weak promoters" also encompasses promoters that are expressed in only a few cells and not in others to give a total low level of expression. Where a promoter is expressed at unacceptably high levels, portions of the promoter sequence can be deleted or modified to decrease expression levels.

Such weak constitutive promoters include, for example the core promoter of the Rsyn7 promoter (WO 99/43838 and U.S. Pat. No. 6,072,050), the core 35S CaMV promoter, and the like. Other constitutive promoters include, for example, U.S. Pat. Nos. 5,608,149; 5,608,144; 5,604,121; 5,569,597; 5,466,785; 5,399,680; 5,268,463; 5,608,142; and 6,177,611; herein incorporated by reference.

Generally, the expression cassette will comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D). See generally, Yarranton (1992) *Curr. Opin. Biotech.* 3: 506–511; Christopherson et al. (1992) *Proc. Natl. Acad. Sci. USA* 89: 6314–6318; Yao et al. (1992) *Cell* 71: 63–72; Reznikoff(1992) *Mol. Microbiol.* 6: 2419–2422; Barkley et al. (1980) in *The Operon*, pp. 177–220; Hu et al. (1987) *Cell* 48: 555–566; Brown et al. (1987) *Cell* 49: 603–612; Figge et al. (1988) *Cell* 52: 713–722; Deuschle et al. (1989) *Proc. Natl. Acad. Sci. USA* 86: 5400–5404; Fuerst et al. (1989) *Proc. Natl. Acad. Sci. USA* 86: 2549–2553; Deuschle et al. (1990) *Science* 248: 480–483; Gossen (1993) Ph.D. Thesis, University of Heidelberg; Reines et al. (1993) *Proc. Natl. Acad. Sci. USA* 90: 1917–1921; Labow et al. (1990) *Mol. Cell. Biol.* 10: 3343–3356; Zambretti et al. (1992) *Proc. Natl. Acad. Sci. USA* 89: 3952–3956; Baim et al. (1991) *Proc. Natl. Acad. Sci. USA* 88: 5072–5076; Wyborski et al. (1991) *Nucleic Acids Res.* 19: 4647–4653; Hillenand-Wissman (1989) *Topics Mol. Struc. Biol.* 10: 143–162; Degenkolb et al. (1991) *Antimicrob. Agents Chemother.* 35: 1591–1595; Kleinschnidt et al. (1988) *Biochemistry* 27: 1094–1104; Bonin (1993) Ph.D. Thesis, University of Heidelberg; Gossen et al. (1992) *Proc. Natl. Acad. Sci. USA* 89: 5547–5551; Oliva et al. (1992) *Antimicrob. Agents Chemother.* 36: 913–919; Hlavka et al. (1985) *Handbook of Experimental Pharmacology*, Vol. 78 (Springer-Verlag, Berlin); Gill et al. (1988) *Nature* 334: 721–724. Such disclosures are herein incorporated by reference.

The above list of selectable marker genes is not meant to be limiting. Any selectable marker gene can be used in the present invention.

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway et al. (1986) *Biotechniques* 4: 320–334), electroporation (Riggs et al. (1986) *Proc. Natl. Acad. Sci. USA* 83: 5602–5606, *Agrobacterium*-mediated transformation (Townsend et al., U.S. Pat. No. 5,563,055; Zhao et al., U.S. Pat. No. 5,981,840), direct gene transfer (Paszkowski et al. (1984) *EMBO J.* 3: 2717–2722), and ballistic particle acceleration (see, for example, Sanford et al., U.S. Pat. No. 4,945,050; Tomes et al., U.S. Pat. No. 5,879,918; Tomes et al., U.S. Pat. No. 5,886,244; Bidney et al., U.S. Pat. No. 5,932,782; Tomes et al. (1995) "Direct DNA Transfer into Intact Plant Cells via Microprojectile Bombardment," in *Plant Cell, Tissue, and Organ Culture: Fundamental Methods*, ed. Gamborg and Phillips (Springer-Verlag, Berlin); and McCabe et al. (1988) *Biotechnology* 6: 923–926); and Lecl transformation (WO 00/28058). For potato transformation see Tu et al. (1998) *Plant Molecular Biology* 37: 829–838 and Chong et al. (2000) *Transgenic Research* 9: 71–78. Additional transformation procedures can be found in Weissinger et al. (1988) *Ann. Rev. Genet.* 22: 421–477; Sanford et al. (1987) *Particulate Science and Technology* 5: 27–37 (onion); Christou et al. (1988) *Plant Physiol.* 87: 671–674 (soybean); McCabe et al. (1988) *Bio/Technology* 6: 923–926 (soybean); Finer and McMullen (1991) *In Vitro Cell Dev. Biol.* 27P: 175–182 (soybean); Singh et al. (1998) *Theor. Appl. Genet.* 96: 319–324 (soybean); Datta et al. (1990) *Biotechnology* 8: 736–740 (rice); Klein et al. (1988) *Proc. Natl. Acad. Sci. USA* 85: 4305–4309 (maize); Klein et al. (1988) *Biotechnology* 6: 559–563 (maize); Tomes, U.S. Pat. No. 5,240,855; Buising et al., U.S. Pat. Nos. 5,322,783 and 5,324,646; Klein et al. (1988) *Plant Physiol.* 91: 440–444 (maize); Fromm et al. (1990) *Biotechnology* 8: 833–839 (maize); Hooykaas-Van Slogteren et al. (1984) *Nature* (London) 311: 763–764; Bowen et al., U.S. Pat. No. 5,736,369 (cereals); Bytebier et al. (1987) *Proc. Natl. Acad. Sci. USA* 84: 5345–5349 (Liliaceae); De Wet et al. (1985) in *The Experimental Manipulation of Ovule Tissues*, ed. Chapman et al. (Longman, N.Y.), pp. 197–209 (pollen); Kaeppler et al. (1990) *Plant Cell Reports* 9: 415–418 and Kaeppler et al. (1992) *Theor. Appl. Genet.* 84: 560–566 (whisker-mediated transformation); D'Halluin et al. (1992) *Plant Cell* 4: 1495–1505 (electroporation); Li et al. (1993) *Plant Cell Reports* 12: 250–255 and Christou and Ford (1995) *Annals of Botany* 75: 407–413 (rice); Osjoda et al. (1996) *Nature Biotechnology* 14: 745–750 (maize via *Agrobacterium tumefaciens*); all of which are herein incorporated by reference.

The cells that have been transformed may be grown into plants in accordance with conventional ways. See, for example, McCormick et al. (1986) *Plant Cell Reports* 5: 81–84. These plants may then be grown, and either pollinated with the same transformed strain or different strains, and the resulting hybrid having constitutive or inducible expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved.

The nucleotide sequences of the invention may be provided to the plant by contacting the plant with a virus or viral nucleic acids. Generally, such methods involve incorporating the nucleotide construct of interest within a viral DNA or RNA molecule. It is recognized that the recombinant proteins of the invention may be initially synthesized as part of a viral polyprotein, which later may be processed by proteolysis in vivo or in vitro to produce the desired pesticidal protein. It is also recognized that such a viral polyprotein, comprising at least a portion of the amino acid sequence of a pesticidal protein of the invention, may have the desired pesticidal activity. Such viral polyproteins and the nucleotide sequences that encode for them are encompassed by the present invention. Methods for providing plants with nucleotide constructs and producing the encoded proteins in the plants, which involve viral DNA or RNA molecules are known in the art. See, for example, U.S. Pat. Nos. 5,889,191; 5,889,190; 5,866,785; 5,589,367; and 5,316,931; herein incorporated by reference.

The invention further relates to plant propagating material of a transformed plant of the invention including, but not limited to, seeds, tubers, corms, bulbs, leaves, and cuttings of roots and shoots.

The present invention may be used for transformation of any plant species, including, but not limited to, monocots and dicots. Examples of plants of interest include, but are not limited to, corn (*Zea mays*), *Brassica* spp. (e.g., canola (*B. napus*), *B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables, ornamentals, and conifers.

Vegetables include tomatoes (Lycopersicon esculentum), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum. Conifers that may be employed in practicing the present invention include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow cedar (*Chamaecyparis nootkatensis*). Plants of the present invention include crop plants (for example, corn, alfalfa, sunflower, *Brassica*, soybean, cotton, safflower, peanut, sorghum, wheat, millet, tobacco, etc.), as well as turf grasses.

Turfgrasses include, but are not limited to: annual bluegrass (*Poa annua*); annual ryegrass (*Lolium multiflorum*); Canada bluegrass (*Poa compressa*); Chewings fescue (*Festuca rubra*); colonial bentgrass (*Agrostis tenuis*); creeping bentgrass (*Agrostis palustris*); crested wheatgrass (*Agropyron desertorum*); fairway wheatgrass (*Agropyron cristatum*); hard fescue (*Festuca longifolia*); Kentucky bluegrass (*Poa pratensis*); orchardgrass (*Dactylis glomerata*); perennial ryegrass (*Lolium perenne*); red fescue (*Festuca rubra*); redtop (*Agrostis alba*); rough bluegrass (*Poa trivialis*); sheep fescue (*Festuca ovina*); smooth bromegrass (*Bromus inermis*); tall fescue (*Festuca arundinacea*); timothy (*Phleum pratense*); velvet bentgrass (*Agrostis canina*); weeping alkaligrass (*Puccinellia distans*); western wheatgrass (*Agropyron smithii*); Bermuda grass (*Cynodon* spp.); St. Augustine grass (*Stenotaphrum secundatum*); zoysia grass (*Zoysia* spp.); Bahia grass (*Paspalum notatum*); carpet grass (*Axonopus affinis*); centipede grass (*Eremochloa ophiuroides*); kikuyu grass (*Pennisetum clandesinum*); seashore paspalum (*Paspalum vaginatum*); blue gramma (*Bouteloua gracilis*); buffalo grass (*Buchloe dactyloids*); sideoats gramma (*Bouteloua curtipendula*).

Plants of interest include grain plants that provide seeds of interest, oil-seed plants, and leguminous plants. Seeds of interest include grain seeds, such as corn, wheat, barley, rice, sorghum, rye, millet, etc. Oil-seed plants include cotton, soybean, safflower, sunflower, *Brassica*, maize, alfalfa, palm, coconut, flax, castor, olive etc. Leguminous plants include beans and peas. Beans include guar, locust bean, fenugreek, soybean, garden beans, cowpea, mungbean, lima bean, fava bean, lentils, chickpea, etc.

Compositions of the invention find use in protecting plants, seeds, and plant products in a variety of ways. For example, the compositions can be used in a method that involves placing an effective amount of the pesticidal composition in the environment of the pest by a procedure selected from the group consisting of spraying, dusting, broadcasting, or seed coating.

Before plant propagation material (fruit, tuber, bulb, corm, grains, seed), but especially seed, is sold as a commercial product, it is customarily treated with a protectant coating comprising herbicides, insecticides, fungicides, bactericides, nematicides, molluscicides, or mixtures of several of these preparations, if desired together with further carriers, surfactants, or application-promoting adjuvants customarily employed in the art of formulation to provide protection against damage caused by bacterial, fungal, or animal pests. In order to treat the seed, the protectant coating may be applied to the seeds either by impregnating the tubers or grains with a liquid formulation or by coating them with a combined wet or dry formulation. In addition, in special cases, other methods of application to plants are possible, e.g., treatment directed at the buds or the fruit.

The plant seed of the invention comprising a DNA molecule comprising a nucleotide sequence encoding a pesticidal protein of the invention may be treated with a seed protectant coating comprising a seed treatment compound, such as, for example, captan, carboxin, thiram, methalaxyl, pirimiphos-methyl, and others that are commonly used in seed treatment. In one embodiment within the scope of the invention, a seed protectant coating comprising a pesticidal composition of the invention is used alone or in combination with one of the seed protectant coatings customarily used in seed treatment.

It is recognized that the genes encoding the pesticidal proteins can be used to transform insect pathogenic organisms. Such organisms include Baculoviruses, fungi, protozoa, bacteria, and nematodes.

A gene encoding a pesticidal protein of the invention may be introduced via a suitable vector into a microbial host, and said host applied to the environment, or to plants or animals. The term "introduced" in the context of inserting a nucleic acid into a cell, means "transfection" or "transformation" or "transduction" and includes reference to the incorporation of a nucleic acid into a eukaryotic or prokaryotic cell where the nucleic acid may be incorporated into the genome of the cell (e.g., chromosome, plasmid, plastid, or mitochondrial DNA), converted into an autonomous replicon, or transiently expressed (e.g., transfected mRNA).

Microorganism hosts that are known to occupy the "phytosphere" (phylloplane, phyllosphere, rhizosphere, and/or rhizoplana) of one or more crops of interest may be selected. These microorganisms are selected so as to be capable of successfully competing in the particular environment with the wild-type microorganisms, provide for stable maintenance and expression of the gene expressing the pesticidal protein, and desirably, provide for improved protection of the pesticide from environmental degradation and inactivation.

Such microorganisms include bacteria, algae, and fungi. Of particular interest are microorganisms such as bacteria, e.g., *Pseudomonas, Erwinia, Serratia, Klebsiella, Xanthomonas, Streptomyces, Rhizobium, Rhodopseudomonas, Methylius, Agrobacterium, Acetobacter, Lactobacillus, Arthrobacter, Azotobacter, Leuconostoc,* and *Alcaligenes*, fungi, particularly yeast, e.g., *Saccharomyces, Cryptococ-* cus, Kluyveromyces, Sporobolomyces, Rhodotorula, and Aureobasidium. Of particular interest are such phytosphere bacterial species as Pseudomonas syringae, Pseudomonas fluorescens, Serratia marcescens, Acetobacter xylinum, Agrobacteria, Rhodopseudomonas spheroides, Xanthomonas campestris, Rhizobium melioti, Alcaligenes entrophus, Clavibacter xyli and Azotobacter vinlandir and phytosphere yeast species such as Rhodotorula rubra, R. glutinis, R. marina, R. aurantiaca, Cryptococcus albidus, C. diffluens, C. laurentii, Saccharomyces rosei, S. pretoriensis, S. cerevisiae, Sporobolomyces rosues, S. odorus, Kluyveromyces veronae, and Aureobasidium pollulans. Of particular interest are the pigmented microorganisms.

A number of ways are available for introducing a gene expressing the pesticidal protein into the microorganism host under conditions that allow for stable maintenance and expression of the gene. For example, expression cassettes can be constructed which include the nucleotide constructs of interest operably linked with the transcriptional and translational regulatory signals for expression of the nucleotide constructs, and a nucleotide sequence homologous with a sequence in the host organism, whereby integration will occur, and/or a replication system that is functional in the host, whereby integration or stable maintenance will occur.

Transcriptional and translational regulatory signals include, but are not limited to, promoters, transcriptional initiation start sites, operators, activators, enhancers, other regulatory elements, ribosomal binding sites, an initiation codon, termination signals, and the like. See, for example, U.S. Pat. Nos. 5,039,523 and 4,853,331; EPO 0480762A2; Sambrook et al. (1992) *Molecular Cloning: A Laboratory Manual*, ed. Maniatis et al. (Cold Spring Harbor Laboratory Press, Cold Spring Harbor, N.Y.); Davis et al., eds. (1980) *Advanced Bacterial Genetics* (Cold Spring Harbor Laboratory Press), Cold Spring Harbor, N.Y.; and the references cited therein.

Suitable host cells, where the pesticidal protein-containing cells will be treated to prolong the activity of the pesticidal proteins in the cell when the treated cell is applied to the environment of the target pest(s), may include either prokaryotes or eukaryotes, normally being limited to those cells that do not produce substances toxic to higher organisms, such as mammals. However, organisms that produce substances toxic to higher organisms could be used, where the toxin is unstable or the level of application sufficiently low as to avoid any possibility of toxicity to a mammalian host. As hosts, of particular interest will be the prokaryotes and the lower eukaryotes, such as fungi. Illustrative prokaryotes, both Gram-negative and gram-positive, include *Enterobacteriaceae*, such as *Escherichia, Erwinia, Shigella, Salmonella*, and *Proteus; Bacillaceae; Rhizobiceae*, such as *Rhizobium; Spirillaceae*, such as photobacterium, *Zymomonas, Serratia, Aeromonas, Vibrio, Desulfovibrio, Spirillum; Lactobacillaceae; Pseudomonadaceae*, such as *Pseudomonas* and *Acetobacter; Azotobacteraceae* and *Nitrobacteraceae*. Among eukaryotes are fungi, such as *Phycomycetes* and *Ascomycetes*, which includes yeast, such as *Saccharomyces* and *Schizosaccharomyces*; and *Basidiomycetes* yeast, such as *Rhodotorula, Aureobasidium, Sporobolomyces*, and the like.

Characteristics of particular interest in selecting a host cell for purposes of pesticidal protein production include ease of introducing the pesticidal protein gene into the host, availability of expression systems, efficiency of expression, stability of the protein in the host, and the presence of auxiliary genetic capabilities. Characteristics of interest for use as a pesticide microcapsule include protective qualities for the pesticide, such as thick cell walls, pigmentation, and intracellular packaging or formation of inclusion bodies; leaf affinity; lack of mammalian toxicity; attractiveness to pests for ingestion; ease of killing and fixing without damage to the toxin; and the like. Other considerations include ease of formulation and handling, economics, storage stability, and the like.

Host organisms of particular interest include yeast, such as *Rhodotorula* spp., *Aureobasidium* spp., *Saccharomyces* spp., and *Sporobolomyces* spp., phylloplane organisms such as *Pseudomonas* spp., *Erwinia* spp., and *Flavobacterium* spp., and other such organisms, including *Pseudomonas aeruginosa, Pseudomonas fluorescens, Saccharomyces cerevisiae, Bacillus thuringiensis, Escherichia coli, Bacillus subtilis*, and the like.

Genes encoding the pesticidal proteins of the invention can be introduced into microorganisms that multiply on plants (epiphytes) to deliver pesticidal proteins to potential target pests. Epiphytes, for example, can be gram-positive or gram-negative bacteria.

Root-colonizing bacteria, for example, can be isolated from the plant of interest by methods known in the art. Specifically, a *Bacillus cereus* strain that colonizes roots can be isolated from roots of a plant (see, for example, Handelsman et al. (1991) *Appl. Environ. Microbiol.* 56:713–718). Genes encoding the pesticidal proteins of the invention can be introduced into a root-colonizing *Bacillus cereus* by standard methods known in the art.

Genes encoding pesticidal proteins can be introduced, for example, into the root-colonizing *Bacillus* by means of electrotransformation. Specifically, genes encoding the pesticidal proteins can be cloned into a shuttle vector, for example, pHT3101 (Lerecius et al. (1989) *FEMS Microbiol. Letts.* 60: 211–218. The shuttle vector pHT3101 containing the coding sequence for the particular pesticidal protein gene can, for example, be transformed into the root-colonizing *Bacillus* by means of electroporation (Lerecius et al. (1989) *FEMS Microbiol. Letts.* 60: 211–218).

Expression systems can be designed so that pesticidal proteins are secreted outside the cytoplasm of gram-negative bacteria, *E. coli*, for example. Advantages of having pesticidal proteins secreted are: (1) avoidance of potential cytotoxic effects of the pesticidal protein expressed; and (2) improvement in the efficiency of purification of the pesticidal protein, including, but not limited to, increased efficiency in the recovery and purification of the protein per volume cell broth and decreased time and/or costs of recovery and purification per unit protein.

Pesticidal proteins can be made to be secreted in *E. coli*, for example, by fusing an appropriate *E. coli* signal peptide to the amino-terminal end of the pesticidal protein. Signal peptides recognized by *E. coli* can be found in proteins already known to be secreted in *E. coli*, for example the OmpA protein (Ghrayeb et al. (1984) *EMBO J*, 3:2437–2442). OmpA is a major protein of the *E. coli* outer membrane, and thus its signal peptide is thought to be efficient in the translocation process. Also, the OmpA signal peptide does not need to be modified before processing as may be the case for other signal peptides, for example lipoprotein signal peptide (Duffaud et al. (1987) *Meth. Enzymol.* 153:492).

Pesticidal proteins of the invention can be fermented in a bacterial host and the resulting bacteria processed and used as a microbial spray in the same manner that *Bacillus thuringiensis* strains have been used as insecticidal sprays. In the case of a pesticidal protein(s) that is secreted from

*Bacillus*, the secretion signal is removed or mutated using procedures known in the art. Such mutations and/or deletions prevent secretion of the pesticidal protein(s) into the growth medium during the fermentation process. The pesticidal proteins are retained within the cell, and the cells are then processed to yield the encapsulated pesticidal proteins. Any suitable microorganism can be used for this purpose. *Pseudomonas* has been used to express *Bacillus thuringiensis* endotoxins as encapsulated proteins and the resulting cells processed and sprayed as an insecticide (Gaertner et al. (1993), in: *Advanced Engineered Pesticides*, ed. Kim).

Alternatively, the pesticidal proteins are produced by introducing a heterologous gene into a cellular host. Expression of the heterologous gene results, directly or indirectly, in the intracellular production and maintenance of the pesticide. These cells are then treated under conditions that prolong the activity of the toxin produced in the cell when the cell is applied to the environment of target pest(s). The resulting product retains the toxicity of the toxin. These naturally encapsulated pesticidal proteins may then be formulated in accordance with conventional techniques for application to the environment hosting a target pest, e.g., soil, water, and foliage of plants. See, for example EPA 0192319, and the references cited therein.

In the present invention, a transformed microorganism (which includes whole organisms, cells, spore(s), pesticidal protein(s), pesticidal component(s), pest-impacting component(s), mutant(s), preferably living or dead cells and cell components, including mixtures of living and dead cells and cell components, and including broken cells and cell components) or an isolated pesticidal protein can be formulated with an acceptable carrier into a pesticidal composition(s) that is, for example, a suspension, a solution, an emulsion, a dusting powder, a dispersible granule, a wettable powder, and an emulsifiable concentrate, an aerosol, an impregnated granule, an adjuvant, a coatable paste, and also encapsulations in, for example, polymer substances.

Such compositions disclosed above may be obtained by the addition of a surface-active agent, an inert carrier, a preservative, a humectant, a feeding stimulant, an attractant, an encapsulating agent, a binder, an emulsifier, a dye, a UV protectant, a buffer, a flow agent or fertilizers, micronutrient donors, or other preparations that influence plant growth. One or more agrochemicals including, but not limited to, herbicides, insecticides, fungicides, bactericides, nematicides, molluscicides, acaracides, plant growth regulators, harvest aids, and fertilizers, can be combined with carriers, surfactants or adjuvants customarily employed in the art of formulation or other components to facilitate product handling and application for particular target pests. Suitable carriers and adjuvants can be solid or liquid and correspond to the substances ordinarily employed in formulation technology, e.g., natural or regenerated mineral substances, solvents, dispersants, wetting agents, tackifiers, binders, or fertilizers. The active ingredients of the present invention are normally applied in the form of compositions and can be applied to the crop area, plant, or seed to be treated. For example, the compositions of the present invention may be applied to grain in preparation for or during storage in a grain bin or silo, etc. The compositions of the present invention may be applied simultaneously or in succession with other compounds. Methods of applying an active ingredient of the present invention or an agrochemical composition of the present invention that contains at least one of the pesticidal proteins produced by the bacterial strains of the present invention include, but are not limited to, foliar application, seed coating, and soil application. The number of applications and the rate of application depend on the intensity of infestation by the corresponding pest.

Suitable surface-active agents include, but are not limited to, anionic compounds such as a carboxylate of, for example, a metal; carboxylate of a long chain fatty acid; an N-acylsarcosinate; mono or di-esters of phosphoric acid with fatty alcohol ethoxylates or salts of such esters; fatty alcohol sulfates such as sodium dodecyl sulfate, sodium octadecyl sulfate or sodium cetyl sulfate; ethoxylated fatty alcohol sulfates; ethoxylated alkylphenol sulfates; lignin sulfonates; petroleum sulfonates; alkyl aryl sulfonates such as alkyl-benzene sulfonates or lower alkylnaphtalene sulfonates, e.g., butyl-naphthalene sulfonate; salts of sulfonated naphthalene-formaldehyde condensates; salts of sulfonated phenol-formaldehyde condensates; more complex sulfonates such as the amide sulfonates, e.g., the sulfonated condensation product of oleic acid and N-methyl taurine; or the dialkyl sulfosuccinates, e.g., the sodium sulfonate or dioctyl succinate. Non-ionic agents include condensation products of fatty acid esters, fatty alcohols, fatty acid amides or fatty-alkyl- or alkenyl-substituted phenols with ethylene oxide, fatty esters of polyhydric alcohol ethers, e.g., sorbitan fatty acid esters, condensation products of such esters with ethylene oxide, e.g., polyoxyethylene sorbitar fatty acid esters, block copolymers of ethylene oxide and propylene oxide, acetylenic glycols such as 2,4,7,9-tetraethyl-5-decyn-4,7-diol, or ethoxylated acetylenic glycols. Examples of a cationic surface-active agent include, for instance, an aliphatic mono-, di-, or polyamine such as an acetate, naphthenate or oleate; or oxygen-containing amine such as an amine oxide of polyoxyethylene alkylamine; an amide-linked amine prepared by the condensation of a carboxylic acid with a di- or polyamine; or a quaternary ammonium salt.

Examples of inert materials include but are not limited to inorganic minerals such as kaolin, phyllosilicates, carbonates, sulfates, phosphates, or botanical materials such as cork, powdered corncobs, peanut hulls, rice hulls, and walnut shells.

The compositions of the present invention can be in a suitable form for direct application or as a concentrate of primary composition that requires dilution with a suitable quantity of water or other diluant before application. The pesticidal concentration will vary depending upon the nature of the particular formulation, specifically, whether it is a concentrate or to be used directly. The composition contains 1 to 98% of a solid or liquid inert carrier, and 0 to 50%, preferably 0.1 to 50% of a surfactant. These compositions will be administered at the labeled rate for the commercial product, preferably about 0.01 lb–5.0 lb. per acre when in dry form and at about 0.01 pts.–10 pts. per acre when in liquid form.

In a further embodiment, the compositions, as well as the transformed microorganisms and pesticidal proteins, of the invention can be treated prior to formulation to prolong the pesticidal activity when applied to the environment of a target pest as long as the pretreatment is not deleterious to the activity. Such treatment can be by chemical and/or physical means as long as the treatment does not deleteriously affect the properties of the composition(s). Examples of chemical reagents include but are not limited to halogenating agents; aldehydes such a formaldehyde and glutaraldehyde; anti-infectives, such as zephiran chloride; alcohols, such as isopropanol and ethanol; and histological fixatives, such as Bouin's fixative and Helly's fixative (see, for example, Humason (1967) *Animal Tissue Techniques* (W. H. Freeman and Co.).

In other embodiments of the invention, it may be advantageous to treat the polypeptides with a protease, for example trypsin, to activate the protein prior to application of a pesticidal protein composition of the invention to the environment of the target pest. Methods for the activation of protoxin by a serine protease are well known in the art. See, for example, Cooksey (1968) *Biochem. J.* 6:445–454 and Carroll and Ellar (1989) *Biochem. J.* 261:99–105, the teachings of which are herein incorporated by reference. For example, a suitable activation protocol includes, but is not limited to, combining a polypeptide to be activated, for example a purified 1218-1 polypeptide, and trypsin at a 1/100 weight ratio of 1218-1 protein/trypsin in 20nM NaHCO3, pH 8 and digesting the sample at 36° C. for 3 hours.

The compositions (including the transformed microorganisms and pesticidal proteins of the invention) can be applied to the environment of an insect pest by, for example, spraying, atomizing, dusting, scattering, coating or pouring, introducing into or on the soil, introducing into irrigation water, by seed treatment or general application or dusting at the time when the pest has begun to appear or before the appearance of pests as a protective measure. For example, the pesticidal protein and/or transformed microorganisms of the invention may be mixed with grain to protect the grain during storage. It is generally important to obtain good control of pests in the early stages of plant growth, as this is the time when the plant can be most severely damaged. The compositions of the invention can conveniently contain another insecticide if this is thought necessary. In an embodiment of the invention, the composition is applied directly to the soil, at a time of planting, in granular form of a composition of a carrier and dead cells of a *Bacillus* strain or transformed microorganism of the invention. Another embodiment is a granular form of a composition comprising an agrochemical such as, for example, a herbicide, an insecticide, a fertilizer, an inert carrier, and dead cells of a *Bacillus* strain or transformed microorganism of the invention.

The embodiments of the present invention may be effective against a variety of pests. For purposes of the present invention, pests include, but are not limited to, insects, fungi, bacteria, nematodes, acarids, protozoan pathogens, animal-parasitic liver flukes, and the like. Pests of particular interest are insect pests, particularly insect pests that cause significant damage to agricultural plants. By "insect pests" is intended insects and other similar pests such as, for example, those of the order Acari including, but not limited to, mites and ticks. Insect pests of the present invention include, but are not limited to, insects of the order Lepidoptera, e.g. *Achoroia grisella, Acleris gloverana, Acleris variana, Adoxophyes orana, Agrotis ipsilon, Alabama argillacea, Alsophila pometaria, Amyelois transitella, Anagasta kuehniella, Anarsia lineatella, Anisota senatoria, Antheraea pernyi, Anticarsia gemmatalis, Archips* sp., *Argyrotaenia* sp., *Athetis mindara, Bombyx mori, Bucculatrix thurberiella, Cadra cautella, Choristoneura* sp., *Cochylls hospes, Colias eurytheme, Corcyra cephalonica, Cydia latiferreanus, Cydia pomonella, Datana integerrima, Dendrolimus sibericus, Desmia feneralis, Diaphania hyalinata, Diaphania nitidalis, Diatraea grandiosella, Diatraea saccharalis, Ennomos subsignaria, Eoreuma loftini, Esphestia elutella, Erannis tilaria, Estigmene acrea, Eulia salubricola, Eupocoellia ambiguella, Eupoecilia ambiguella, Euproctis chrysorrhoea, Euxoa messoria, Galleria mellonella, Grapholita molesta, Harrisina americana, Helicoverpa subflexa, Helicoverpa zea, Heliothis virescens, Hemileuca oliviae, Homoeosoma electellum, Hyphantia cunea, Keiferia lycopersicella, Lambdina fiscellaria fiscellaria, Lambdina fiscellaria lugubrosa, Leucoma salicis, Lobesia botrana, Loxostege sticticalis, Lymantria dispar, Macalla thyrisalis, Malacosoma* sp., *Mamestra brassicae, Mamestra configurata, Manduca quinquemaculata, Manduca sexta, Maruca testulalis, Melanchra picta, Operophtera brumata, Orgyia* sp., *Ostrinia nubilalis, Paleacrita vernata, Papilio cresphontes, Pectinophora gossypiella, Phryganidia californica, Phyllonorycter blancardella, Pieris napi, Pieris rapae, Plathypena scabra, Platynota flouendana, Platynota stultana, Platyptilia carduidactyla, Plodia interpunctella, Plutella xylostella, Pontia protodice, Pseudaletia unipuncta, Pseudoplasia includens, Sabulodes aegrotata, Schizura concinna, Sitotroga cerealella, Spilonta ocellana, Spodoptera* sp., *Thaurnstopoea pityocampa, Tinsola bisselliella, Trichoplusia hi, Udea rubigalis, Xylomyges curiails*, and *Yponomeuta padella.*

Also, the embodiments of the present invention may be effective against insect pests including insects selected from the orders Diptera, Hymenoptera, Lepidoptera, Mallophaga, Homoptera, Hemiptera, Orthroptera, Thysanoptera, Dermaptera, Isoptera, Anoplura, Siphonaptera, Trichoptera, etc., particularly Coleoptera, especially *Diabrotica virgifera* and Lepidoptera. Insect pests of the invention for the major crops include, but are not limited to: Maize: *Ostrinia nubilalis*, European corn borer; *Agrotis ipsilon*, black cutworm; *Helicoverpa zea*, corn earworm; *Spodoptera frugiperda*, fall armyworm; *Diatraea grandiosella*, southwestern corn borer; *Elasmopalpus lignosellus*, lesser cornstalk borer; *Diatraea saccharalis*, surgarcane borer; western corn rootworm, e.g., *Diabrotica virgifera virgifera*; northern corn rootworm, e.g., *Diabrotica longicornis barberi*; southern corn rootworm, e.g., *Diabrotica undecimpunctata howardi; Melanotus* spp., wireworms; *Cyclocephala borealis*, northern masked chafer (white grub); *Cyclocephala immaculata*, southern masked chafer (white grub); *Popillia japonica*, Japanese beetle; *Chaetocnema pulicaria*, corn flea beetle; *Sphenophorus maidis*, maize billbug; *Rhopalosiphum maidis*, corn leaf aphid; *Anuraphis maidiradicis*, corn root aphid; *Blissus leucopterus leucopterus*, chinch bug; *Melanoplus femurrubrum*, redlegged grasshopper; *Melanoplus sanguinipes*, migratory grasshopper; *Hylemya platura*, seedcorn maggot; *Agromyza parvicornis*, corn blotch leafminer; *Anaphothrips obscrurus*, grass thrips; *Solenopsis milesta*, thief ant; *Tetranychus urticae*, two spotted spider mite; Sorghum: *Chilo partellus*, sorghum borer; *Spodoptera frugiperda*, fall armyworm; *Helicoverpa zea*, corn earworm; *Elasmopalpus lignosellus*, leser cornstalk borer; *Feltia subterranea*, granulate cutworm; *Phyllophaga crinita*, white grub; *Eleodes, Conoderus,* and *Aeolus* spp., wireworms; *Oulema melanopus*, cereal leaf beetle; *Chaetocnema pulicaria*, corn flea beetle; *Sphenophorus maidis*, maize billbug; *Rhopalosiphum maidis*; corn leaf aphid; *Sipha flava*, yellow sugarcane aphid; chinch bug, e.g., *Blissus leucopterus leucopterus; Contarinia sorghicola*, sorghum midge; *Tetranychus cinnabarinus*, carmine spider mite; *Tetranychus urticae*, two-spotted spider mite; Wheat: *Pseudaletia unipunctata*, army worm; *Spodoptera frugiperda*, fall armyworm; *Elasmopalpus lignosellus*, lesser cornstalk borer; *Agrotis orthogonia*, pale western cutworm; *Elasmopalpus lignosellus*, lesser cornstalk borer; *Oulema melanopus*, cereal leaf beetle; *Hypera punctata*, clover leaf weevil; southern corn rootworm, e.g., *Diabrotica undecimpunctata howardi*; Russian wheat aphid; *Schizaphis graminum*, greenbug; *Macrosiphum avenae*, English grain aphid; *Melanoplus femurrubrum*, redlegged grasshopper; *Melanoplus differentialis*, differential grasshopper; *Melanoplus san-*

*guinipes*, migratory grasshopper; *Mayetiola destructor*, Hessian fly; *Sitodiplosis mosellana*, wheat midge; *Meromyza americana*, wheat stem maggot; *Hylemya coarctata*, wheat bulb fly; *Frankliniella fusca*, tobacco thrips; *Cephus cinctus*, wheat stem sawfly; *Aceria tulipae*, wheat curl mite; Sunflower: *Cylindrocupturus adspersus*, sunflower stem weevil; *Smicronyx fulus*, red sunflower seed weevil; *Smicronyx sordidus*, gray sunflower seed weevil; *Suleima helianthana*, sunflower bud moth; *Homoeosoma electellum*, sunflower moth; *Zygogramma exclamationis*, sunflower beetle; *Bothyrus gibbosus*, carrot beetle; *Neolasioptera murtfeldtiana*, sunflower seed midge; Cotton: *Heliothis virescens*, tobacco budworm; *Helicoverpa zea*, cotton bollworm; *Spodoptera exigua*, beet armyworm; *Pectinophora gossypiella*, pink bollworm; boll weevil, e.g., *Anthonomus grandis; Aphis gossypii*, cotton aphid; *Pseudatomoscelis seriatus*, cotton fleahopper; *Trialeurodes abutilonea*, bandedwinged whitefly; *Lygus lineolaris*, tarnished plant bug; *Melanoplus femurrubrum*, redlegged grasshopper; *Melanoplus differentialis*, differential grasshopper; *Thrips tabaci*, onion thrips; *Franklinkiella fusca*, tobacco thrips; *Tetranychus cinnabarinus*, carmine spider mite; *Tetranychus urticae*, two-spotted spider mite; Rice: *Diatraea saccharalis*, sugarcane borer; *Spodoptera frugiperda*, fall armyworm; *Helicoverpa zea*, corn earworm; *Colaspis brunnea*, grape colaspis; *Lissorhoptrus oryzophilus*, rice water weevil; *Sitophilus oryzae*, rice weevil; *Nephotettix nigropictus*, rice leafhoper; chinch bug, e.g., *Blissus leucopterus leucopterus; Acrosternum hilare*, green stink bug; Soybean: *Pseudoplusia includens*, soybean looper; *Anticarsia gemmatalis*, velvetbean caterpillar; *Plathypena scabra*, green cloverworm; *Ostrinia nubilalis*, European corn borer; *Agrotis ipsilon*, black cutworm; *Spodoptera exigua*, beet armyworm; *Heliothis virescens*, tobacco budworm; *Helicoverpa zea*, cotton bollworm; *Epilachna varivestis*, Mexican bean beetle; *Myzus persicae*, green peach aphid; *Empoasca fabae*, potato leafhopper; *Acrosternum hilare*, green stink bug; *Melanoplus femurrubrum*, redlegged grasshopper; *Melanoplus differentialis*, differential grasshopper; *Hylemya platura*, seedcorn maggot; *Sericothrips variabilis*, soybean thrips; *Thrips tabaci*, onion thrips; *Tetranychus turkestani*, strawberry spider mite; *Tetranychus urticae*, two-spotted spider mite; Barley: *Ostrinia nubilalis*, European corn borer; *Agrotis ipsilon*, black cutworm; *Schizaphis graminum*, greenbug; chinch bug, e.g., *Blissus leucopterus leucopterus; Acrosternum hilare*, green stink bug; *Euschistus servus*, brown stink bug; *Jylemya platura*, seedcorn maggot; *Mayetiola destructor*, Hessian fly; *Petrobia latens*, brown wheat mite; Oil Seed Rape: *Vrevicoryne brassicae*, cabbage aphid; *Phyllotreta cruciferae*, crucifer flea beetle; *Phyllotreta striolata*, striped flea beetle; *Phyllotreta nemorum*, striped turnip flea beetle; *Meligethes aeneus*, rapeseed beetle; and the pollen beetles *Meligethes rufimanus, Meligethes nigrescens, Meligethes canadianus*, and *Meligethes viridescens*; Potato: *Leptinotarsa decemlineata*, Colorado potato beetle.

Furthermore, embodiments of the present invention may be effective against *Hemiptera* such as *Lygus hesperus, Lygus lineolaris, Lygus pratensis, Lygus rugulipennis* Popp, *Lygus pabulinus, Calocoris norvegicus, Orthops compestris, Plesiocoris rugicollis, Cyrtopeltis modestus, Cyrtopeltis notatus, Spanagonicus albofasciatus, Diaphnocoris chlorinonis, Labopidicola allii, Pseudomoscelis seriatus, Adelphocoris rapidus, Poecilocapsus lineatus, Blissus leucopterus, Nysius ericae, Nysiusraphanus, Euschistus servus, Nezara viridula, Eurygaster, Coreidae, Pyrrhocoridae, Tinidae, Blostomatidae, Reduviidae*, and *Cimicidae*. Pests of interest also include *Araecerus fasciculatus*, coffee bean weevil; *Acanthoscelides obtectus*, bean weevil; *Bruchus rufimanus*, broadbean weevil; *Bruchus pisorum*, pea weevil; *Zabrotes subfasciatus*, Mexican bean weevil; *Diabrotica balteata*, banded cucumber beetle; *Cerotoma trifurcata*, bean leaf beetle; *Diabrotica virgifera*, Mexican corn rootworm; *Epitrix cucumeris*, potato flea beetle; *Chaetocnema confinis*, sweet potato flea beetle; *Hypera postica*, alfalfa weevil; *Anthonomus quadrigibbus*, apple curculio; *Sternechus paludatus*, bean stalk weevil; *Hypera brunnipennis*, Egyptian alfalfa weevil; *Sitophilus granaries*, granary weevil; *Craponius inaequalis*, grape curculio; *Sitophilus zeamais*, maize weevil; *Conotrachelus nenuphar*, plum curculio; *Euscepes postfaciatus*, West Indian sweet potato weevil; *Maladera castanea*, Asiatic garden beetle; *Rhizotrogus majalis*, European chafer; *Macrodactylus subspinosus*, rose chafer; *Tribolium confusum*, confused flour beetle; *Tenebrio obscurus*, dark mealworm; *Tribolium castaneum*, red flour beetle; *Tenebrio molitor*, yellow mealworm.

Nematodes include plant-parasitic nematodes such as root-knot, cyst, and lesion nematodes, including *Heterodera* and *Globodera* spp. such as *Globodera rostochiensis* and *Globodera pailida* (potato cyst nematodes); *Heterodera glycines* (soybean cyst nematode); *Heterodera schachtii* (beet cyst nematode); and *Heterodera avenae* (cereal cyst nematode).

The preferred developmental stage for testing for pesticidal activity is larvae or immature forms of these above mentioned insect pests. The insects may be reared in total darkness at from about 20° C. to about 30° C. and from about 30% to about 70% relative humidity. Bioassays may be performed as described in Czapla and Lang (1990) *J. Econ. Entomol.* 83(6): 2480–2485. Methods of rearing insect larvae and performing bioassays are well known to one of ordinary skill in the art.

A wide variety of bioassay techniques is known to one skilled in the art. General procedures include addition of the experimental compound or organism to the diet source in an enclosed container. Pesticidal activity can be measured by, but is not limited to, changes in mortality, weight loss, attraction, repellency and other behavioral and physical changes after feeding and exposure for an appropriate length of time. Bioassays described herein can be used with any feeding insect pest in the larval or adult stage.

The following examples are presented by way of illustration, not by way of limitation.

EXPERIMENTAL

EXAMPLE 1

Bioassay for Testing the Pesticidal Activity of *B. thuringiensis* Strains Against Western Corn Rootworm and Southern Corn Rootworm Insect diets for Colorado potato beetle (CPB), southern corn rootworm (SCRW), and western corn rootworm (WCRW) larvae are known in the art. See, for example, Rose and McCabe (1973) *J. Econ. Entomology* 66:393, herein incorporated by reference. The insect diet is prepared and poured into a CD International bioassay tray. Generally 1.5 ml of diet is dispensed into each cell with an additional 150 μl of sample preparation applied to the diet surface.

Bacterial colonies from an original plate of transformants expressing the pesticidal proteins of interest are spotted on replica plates and inoculated in 5 ml 2×YT broth with 500 μl/1000 ml kanamycin antibiotic. The tubes are grown overnight. If no growth is present, the tubes are incubated for an additional 24 hours. Following incubation, the tubes are centrifuged at 3500 rpm for 5–8 minutes. The supernatant is discarded and the pellet resuspended in 1000 µl PBS. The sample is then transferred to 1.5 ml Eppendorf tubes and incubated on ice until the temperature is 3 to 4° C., followed by sonication for 12–15 seconds.

Microbial culture broths (150 µl) or other samples (150 µ) are overlaid onto artificial diets. The trays are allowed to dry. Rootworm larvae are dispensed into the wells of the bioassay tray. Lids are placed on the bioassay trays and the samples are incubated for 4–7 days at a temperature of 26° C. The bioassays are then scored by counting "live" versus "dead" larvae. Mortality is calculated as percentage of dead larvae out of the total larvae tested.

EXAMPLE 2

Pesticidal Activity of B. thuringiensis Strain 1218 Lysates

Samples prepared from cultures of B. thuringiensis strains 1218 were tested for the presence of pesticidal activity against CPB, WCRW, and SCRW as described in Example 1. As a control, the diet was treated with phosphate-buffered saline (PBS).

To prepare each sample, an individual colony of a strain growing on an LB plate was selected and used to inoculate a flask containing 50 ml of TB medium. The flask was incubated overnight at 28° C. and 250 rpm. Following the incubation, the culture in the flask was transferred to a tube, and the tube was centrifuged at 4300×g for 15 minutes. The supernatant was discarded and the pellet resuspended in 50 ml of sporulation medium. The tube was centrifuged again at 4300×g for 15 minutes. The second supernatant was discarded, and the second pellet resuspended in 50 ml of sporulation medium. The resuspended culture solution was transferred to a flask, and the flask was then incubated for 48 hours at 28° C. and 250 rpm. Following this incubation, the culture in the flask was transferred to a tube, and the tube was centrifuged at 4300×g for 15 minutes. The supernatant was discarded, and the pellet was resuspended in 10 ml of 1×M9 medium. The sample was then transferred to a 1.5 ml microfuge tube, incubated on ice until the temperature was about 3 to 4° C., and then sonicated for 12–15 seconds. For bioassays, 150 µl of a sonicated sample was used.

Sporulation medium comprises 200 ml of 5×M9 salts solution, 5 ml of salts solution, 5 ml of $CaCl_2$ solution, and $dH_2O$ to a final volume of 1 liter. The solution of 5×M9 salts comprises: 64 g $Na_2HPO_4.7H_2O$; 15 g $KH_2PO_4$; 2.5 g NaCl; 5 g $NH_4Cl$; and $dH_2O$ to a final volume of 1 liter. Salts solution comprises: 2.46 g $MgSO_4.7H_2O$; 0.04 g $MnSO_4.H_2O$; 0.28 g $ZnSO_4.7H_2O$; 0.40 g $FeSO_4.7H_2O$; and $dH_2O$ to a final volume of 1 liter. $CaCl_2$ solution comprises 3.66 g $CaCl_2.2H_2O$ and $dH_2O$ to a final volume of 100 ml.

Samples were tested with and without heating to determine whether the component(s) responsible for the pesticidal activity is heat stable. For the heat treatment, the samples were boiled for 15 minutes prior to use in the bioassay. Unheated samples prepared from strain 1218 exhibited pesticidal activity against southern corn rootworm, with lesser pesticidal activity against western corn rootworm. The samples prepared from strain 1218 lysates caused moderate stunting in the southern corn rootworm larvae. Following heating, the samples had greatly reduced pesticidal activity against both species of rootworms.

The reduction in pesticidal activity following heating indicated that the one or more components of the sample from strain 1218 that is responsible for the pesticidal activity is heat labile. Such a reduction is consistent with one or more of the components being a protein.

EXAMPLE 3

Pesticidal Activity of Crystal Proteins Isolated from B. thuringiensis Strain 1218

Using samples of sporulated cultures of B. thuringiensis strain 1218 prepared as described in Example 2, crystal proteins were isolated and then trypsin-treated using methods known in the art. Briefly, after purification (zonal gradient centrifugation, Renografin-76), the purified crystals were dissolved in alkaline buffer (50 mM $Na_2CO_3$, 10 mM dithiothreitol, pH 10). Prior to use in the assays, the dissolved crystal proteins were concentrated by filtration with Centriprep® (Millipore Corp.) centrifugal filter units with a MW cutoff of 10,000.

It is recognized that under some experimental conditions, it may be advantageous to treat the Cry8-like polypeptides with a protease, for example trypsin, to activate the protein prior to determining the pesticidal activity of a particular sample. Methods for the activation of protoxin by a serine protease are well known in the art. See, for example, Cooksey (1968) Biochem J. 6:445–454 and Carroll and Ellar (1989) Biochem J. 261:99–105; herein incorporated by reference. Isolated crystal proteins were screened for pesticidal activity against western corn rootworm larvae as described in Example 1. Both a new crystal protein preparation and a previously made preparation ("old preparation") from strain 1218 possessed pesticidal activity against western corn rootworms. Dissolved crystal proteins were stored at −80° C. for 20 days before use in the assays.

A skilled artisan will acknowledge that there are numerous indicators of pesticidal activity and that variables such as number of dead insects, or average weight of treated insects can be monitored. For example, pesticidal activity can be conveniently expressed as percent (%) mortality, which is the percentage of dead rootworm larvae out of the total number of larvae.

EXAMPLE 4

Nucleotide Sequences Isolated from B. thuringiensis Strain 1218

An effort was undertaken to isolate the nucleotide sequences that encode the crystal proteins from B. thuringiensis strain 1218. Two nucleotide sequences were isolated from 1218 that have nucleotide sequence and amino acid sequence homology to Cry8Ba1 (GenBank Accession No. U04365). The two Cry8-like coding sequences isolated from strain 1218 have been designated Cry1218-1 (SEQ ID NO: 1), also known as Cry8Bb1, see Genbank Accession No. AX543924 and Cry1218-2 (SEQ ID NO:3), also known as Cry8Bc1, see Genbank Accession No. AX543926. SEQ ID NO:17 and SEQ ID NO:18 provide the nucleic acid sequences of native genomic clones of Cry1218-1 and Cry1218-2, respectively.

To determine if the proteins encoded by variant or mutant polynucleotides of the invention encode proteins with pesticidal activity, each of the nucleic acid sequences was expressed in Escherichia coli. For example, to determine if the 1218-1 or 1218-2 polynucleotide sequences provided herein encode polypeptides with pesticidal activity, truncated nucleotide sequences were prepared. SEQ ID NO: 11 corresponds to nucleotides 1 through 2007 of the nucleotide sequence of Cry1218-1 (SEQ ID NO: 1). SEQ ID NO:13 corresponds to nucleotides 1 through 2019 of the nucleotide sequence of Cry1218-2 (SEQ ID NO:3).

SEQ ID NOs: 11 and 13 encode truncated Cry8-like polypeptides having the amino acid sequences set forth in SEQ ID NO:12 and 14, respectively. Each of the truncated nucleotide sequences (SEQ ID NOs:11 and 13) was separately cloned into a pET28a expression vector and then used to transform *E. coli*. Transformed colonies were selected and grown in liquid culture as described in Example 1. The expressed, N-terminal-His-tagged, truncated Cry8-like proteins were isolated from *E. coli* lysates by affinity chromatography using a nickel affinity column. The column fractions with the protein of interest were dialyzed extensively against 10 mM Tris-HCl (pH 8.5) and then concentrated using Centriprep® (Millipore Corp.) centrifugal filter units with a MW cutoff of 10,000 according to the manufacturer's directions. The concentrated Cry8-like protein samples were tested for the presence of pesticidal activity against western corn rootworm as described in Example 1.

Bioassays evaluating the pesticidal activity of recombinant Cry8-like proteins purified from *E. coli*-expressed preparations were conducted as described in Example 1 with the aqueous protein samples overlaid on the surface of the rootworm diet. The pesticidal activity of wild-type (e.g., native) and mutant endotoxin were assessed against southern corn rootworms. As expected, it was observed that the pesticidal activity decreased as the concentration of the truncated Cry8-like proteins applied to the diet decreased.

Pesticidal activity was also assessed by incorporating the pesticidal proteins into the rootworm diet, as opposed to the method described above, which involved incorporating a protein-containing solution into the diet mixture. For example, sample diets comprising 1000, 500, 400, 300, 200, or 100 ppm of a pesticidal polypeptide incorporated into the diet were assessed.

EXAMPLE 5

Preparation of a Plant-Preferred Nucleotide Sequence Encoding a Pesticidal Protein Because codon usage is different between plants and bacteria, the expression in a plant of a protein encoded by nucleotide sequence of bacterial origin can be limited due to translational inefficiency in the plant. It is known in the art that expression can be increased in a plant by altering the coding sequence of the protein to contain plant-preferred codons. For optimal expression of a protein in a plant, a synthetic nucleotide sequence may be prepared using the amino acid sequence of the protein and back-translating the sequence using plant-preferred codons.

Using such an approach, a portion of the amino acid sequence of the protein encoded by Cry1218-1 (SEQ ID NO:2) was back-translated (i.e., reverse translated) using maize-preferred codons. The resulting plant-preferred nucleotide sequence is set forth in SEQ ID NO:5. The nucleotide sequence set forth in SEQ ID NO:5 encodes a polypeptide (SEQ ID NO:6) that comprises the first 669 amino acids of the amino acid sequence set forth in SEQ ID NO:2. Thus, SEQ ID NOs:6 and 12 encode polypeptides comprising the same amino acid sequence and SEQ ID NO: 11 provides a second polynucleotide that encodes the amino acid sequences set forth in SEQ ID NO:6.

EXAMPLE 6

Bioassay for Testing the Pesticidal Activity of Mutant Cry8-like Polypeptides against Colorado Potato Beetle (*Leptinotarsa decemlineata*)

Protocol

Briefly, bioassay parameters were as follows: Bio-Serv diet (catalog number F9800B, from: BIOSERV, Entomology Division, One 8$^{th}$ Street , Suite 1, Frenchtown, N.J. 08825) was dispensed in a 96 well microtiter plate (catalog number 353918, Becton Dickinson, Franklin Lakes, N.J. 07417-1886) having a surface area of 0.33 cm$^2$. Cry8-like samples (1218-1 and K03) were applied topically to the diet surface. The amino acid sequence of the 1218-1 endotoxin is set forth in SEQ ID NO:2, while the amino acid sequence of the K03 mutant endotoxin is set forth in SEQ ID NO:68. Enough sample material was supplied to provide for 8 observations/sample. After the sample dried, 1 Colorado potato beetle (CPB) neonate was added to each well. Therefore, there was a total of 8 larvae/sample. A Mylar® lid (Clear Lam Packaging, Inc., 1950 Pratt Blvd., Elk Grove Village, Ill. 60007-5993) was affixed to each tray. Bioassay trays were placed in an incubator at 25° C.

Figure 6:
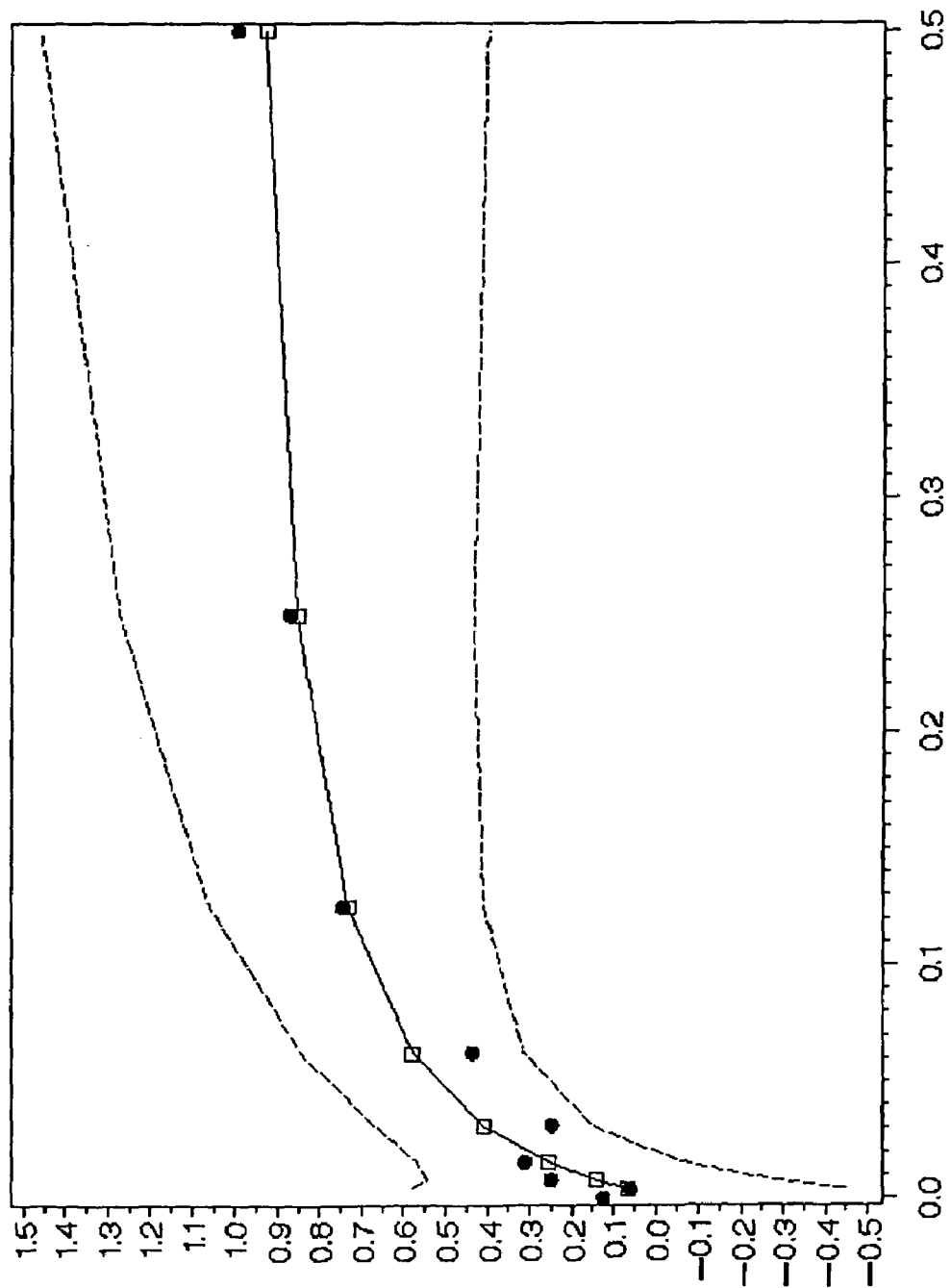
Figure 7:
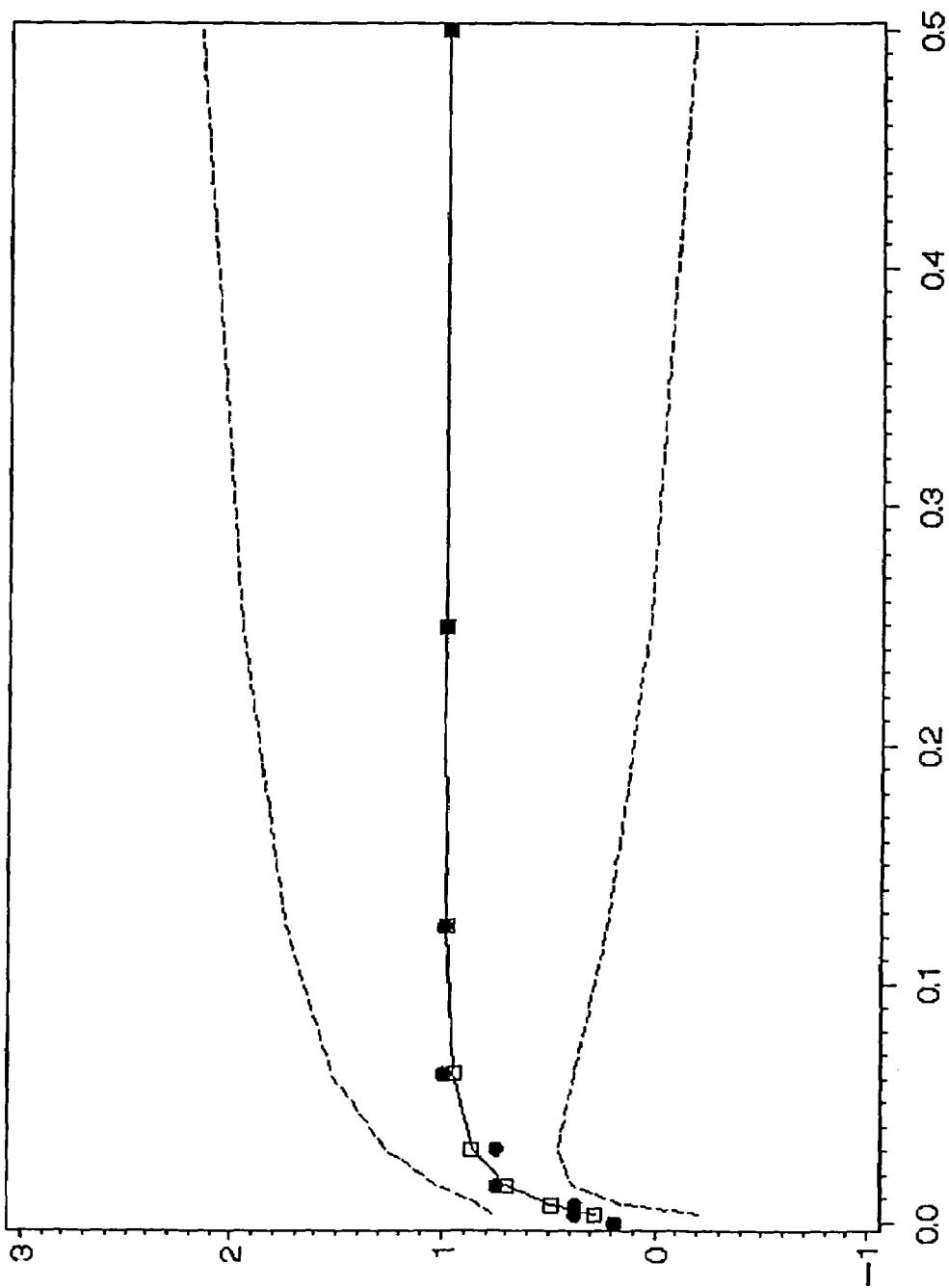

The test was scored for mortality on the 7$^{th}$ day following live infesting. The resulting mortality data was analyzed by a probit model (SAS/STAT Users Guide Version 8 Chapter 54, 1999). The probit analysis of wild type 1218-1 and Cry8-like mutant K03 is shown in FIG. 6 and FIG. 7 respectively.

Results

Sample labeled "I and R" in Table 1 was a control sample consisting of 10 mM carbonate buffer at pH 10. All of the cry 8 like mutant protein samples, 1218-1 (A-H) and K03 (J-Q) were solubilized in 10 mM carbonate buffer at pH 10. Bioassays of 1218-1 and K03 indicated that both protein samples were efficacious against CPB. Cry8-like mutant K03 was found to be more potent than the parent 1218-1 endotoxin. The LC$_{50}$ for Cry8-like mutant K03 was much lower when compared to the wild type 1218-1 protein (Table 2.) Thus, based on diet surface area, it requires about 137 times less protein to achieve a LC$_{50}$ using Cry8-like mutant K03 versus 1218-1 (0.61 µg/cm$^2$ for K03 versus 84 µg/cm$^2$ for 1218-1). Based on probit analysis and LC$_{50}$ determination (Table 2), Cry8-like mutant K03 shows significantly better bioactivity against CPB than 1218-1 wild type.

TABLE 1

Pesticidal Activity of a 1218 Cry8-like (K03) Mutant and Wild Type 1218-1 against Colorado Potato Beetle

| Code | Samples | Protein (mg/ml) | Mortality Rep 1 | Mortality Rep 2 |
| --- | --- | --- | --- | --- |
| A | 1218-1 | 0.5 | *100% | 100% |
| B | 1218-1 | 0.25 | 75% | 100% |
| C | 1218-1 | 0.125 | 50% | 100% |
| D | 1218-1 | 0.0625 | 25% | 63% |
| E | 1218-1 | 0.03125 | 25% | 25% |
| F | 1218-1 | 0.0156 | 38% | 25% |
| G | 1218-1 | 0.0078 | 13% | 38% |
| H | 1218-1 | 0.0039 | 13% | 0% |
| I | buffer | | 13% | 13% |
| J | K03 | 0.5 | 100% | 100% |
| K | K03 | 0.25 | 100% | 100% |
| L | K03 | 0.125 | 100% | 100% |
| M | K03 | 0.0625 | 100% | 100% |
| N | K03 | 0.03125 | 88% | 63% |

TABLE 1-continued

Pesticidal Activity of a 1218 Cry8-like (K03) Mutant
and Wild Type 1218-1 against Colorado Potato Beetle

| Code | Samples | Protein (mg/ml) | Mortality Rep 1 | Mortality Rep 2 |
|------|---------|-----------------|-----------------|-----------------|
| O | K03 | 0.0156 | 75% | 75% |
| P | K03 | 0.0078 | 38% | 38% |
| Q | K03 | 0.0039 | 38% | 38% |
| R | buffer | | 25% | 13% |

*Percent mortality was calculated from 8 observations per concentration.

TABLE 2

$LC_{50}$ Determination of a 1218 Cry8-like (K03) Mutant
and Wild Type 1218-1 against Colorado Potato Beetle

| Sample | $LC_{50}$ (mg/ml) | 95% Fiducial Limits |
|--------|-------------------|---------------------|
| 1218-1 | 1.1098 | 0.6859–2.4485 |
| K03 | 0.00808 | 0.00467–0.01184 |

EXAMPLE 7

Bioassay for Testing the Pesticidal Activity of Mutant Cry8-like Polypeptides Against Southern Corn Rootworm and Western Corn Rootworm Protocol The assay parameters described above in Example 6 are modified to allow for the evaluation of the pesticidal activity of additional mutant polypeptides against western corn rootworm (WCRW) and southern corn rootworm (SCRW). Briefly, Bio-Serv diet (catalog number F9800B, from: BIO-SERV, Entomology Division, One 8$^{th}$ Street, Suite 1, Frenchtown, N.J. 08825) is dispensed in 128-well CD International bioassay trays (catalog number BIO-BA-128 from CD International, Pitman, N.J. 08071).

Endotoxin samples are applied topically to the diet. Enough sample material is supplied to provide for replicate observations per sample. The trays are allowed to dry. Rootworm larvae are dispensed into the wells of the bioassay trays. Lids are placed on the bioassay trays and the samples are incubated for 4–7 days at a temperature of 26° C.

For the evaluation of pesticidal activity against SCRW, insects are exposed to a solution comprising either buffer (50 mM carbonate buffer (pH 10)) or a solution of mutant polypeptide at selected doses, for example, 36 or 3.6 μg/cm$^2$.

For the evaluation of pesticidal activity against WCRW, insects are exposed to a solution comprising either buffer (50 mM carbonate buffer (pH 10)) or to a limited number of mutant polypeptides at a particular dose, e.g., 88 μg/cm$^2$.

The bioassays are then scored by counting "live" versus "dead" larvae. Mortality is calculated as percentage of dead larvae out of the total larvae tested.

EXAMPLE 8

Construction and Evaluation of Mutant Sequences

An experiment was conducted to create and evaluate particular examples of mutant polynucleotide sequences and their encoded mutant proteins. The NGSR1218-1 polynucleotide sequence was cloned into the pET28a–c(+) vector (Nonages Corporation) as a BamHI-XhoI fragment. This construct (pET28/NGSR1218-1) was then used as the starting material for further genetic modification.

A multistep PCR procedure was employed to generate the mutants. Mutagenesis primers were first used in combination with two primers designed from the pET 28 vector as pET forward primer (SEQ ID NO:37) and pET reverse primer (SEQ ID NO:38). The mutagenesis primers used to create the M4 mutant were the M4 forward primer (SEQ ID NO: 27) and the M4 reverse primer (SEQ ID NO: 28); the mutagenesis primers used to create the M5 mutant were the M5 forward primer (SEQ ID NO: 31) and the M5 reverse primer (SEQ ID NO: 32); and the mutagenesis primers used to create the K04 mutant were the K04 forward primer (SEQ ID NO: 23) and the K04 reverse primer (SEQ ID NO: 24). Thus, the amino acid sequence of the M4 mutant endotoxin is set forth in SEQ ID NO:26; the amino acid sequence of the M5 mutant endotoxin is set forth in SEQ ID NO:30; and the amino acid sequence of the K04 mutant endotoxin is set forth in SEQ ID NO:22.

After a first round of PCR, the samples were loaded into a 1% agarose gel, and the expected bands were excised and purified using the Qiaquick gel extraction kit (Qiagen). To generate the mutant polynucleotide, a second round of PCR was performed for 7 cycles without primers. This procedure generated the mutant polynucleotide via overlapping of the homologous mutated region. Subsequently, the flanking pET 28 primers (forward and reverse) were added to generate the mutated polynucleotide sequence.

These modified polynucleotide fragments were then used to replace the corresponding fragment in the pET28/NGSR1218-1 plasmid using standard cloning procedures so that the mutated portions of the polynucleotide were substituted for the corresponding portions of the original polynucleotide. The pET28-based plasmids were used to express the encoded proteins in E. coli.

BL21 Star™ (DE3) cells (Invitrogen) were used as the E. coli host for protein production from the pET28-derived plasmids. The pET28 plasmid provides a "tag," which is a short polypeptide linked to the 3' end of polypeptides generated from the plasmid. This tag provides a mechanism by which the protein can be purified from solution. To produce the protein, the bacterial cultures were grown to a density of approximately $OD_{600}$ 1.0 at 37° C. Cultures were then induced with 200 μg/ml IPTG and incubated overnight at 16° C. The culture cells were then collected and lysed to produce lysate containing the tagged fusion protein of interest. The fusion proteins were purified using the Novagen His tag purification kit. Purified protein concentrations were determined using the BCA protein assay (Pierce).

Mutant proteins were used in a bioassay procedure to evaluate the effect of the mutant polypeptides on pests of interest. Specifically, an experiment was conducted to compare the effects of wild type (native) and mutant polypeptides on WCRW. The rootworms were cultured in bioassay trays. Insect diet was dispensed into each well of the bioassay tray. Test protein samples or control samples were applied topically to the diet. Samples were dried down in a laminar flow hood. Test protein samples were used in the bioassays as described in Table 3 to determine what concentration of protein to use in tests to compare the original protein to the mutant proteins.

TABLE 3

Test protein samples used in bioassays.

Western Corn Rootworm Assays:

| Sample Stock Concentration (mg/ml) | Sample Concentration on Diet (µg/cm²) |
|---|---|
| 2.5 | 225 |
| 1.25 | 112.5 |
| 0.625 | 56.25 |
| 0.3125 | 28.13 |
| 0.1563 | 14.06 |
| 0.0781 | 7.03 |

Colorado Potato Beetle Assays:

| Same Concentration in stock(mg/ml) | Sample Concentration on diet (µg/cm²) |
|---|---|
| 0.500 | 38 |
| 0.250 | 19 |
| 0.125 | 9.5 |
| 0.0 625 | 4.7 |
| 0.03125 | 2.4 |
| 0.0156 | 1.2 |
| 0.0078 | 0.6 |
| 0.0039 | 0.3 |
| Buffer | 0 |

Four observations were made per concentration of test protein.

Mortality and stunting were evaluated at 5 and 7 days post western corn rootworm infestation. The term "stunting" (or "stunted") means the WCRW larva is severely retarded in growth and turns pale yellow to brown in coloration, in contrast to normal larvae of the same stage or instar, which are large, round and creamy white in color.

Another assay format referred to as the "128-well bioassay tray protocol" was also used to evaluate the mutant proteins. Again, insect diet was added to each well of the bioassay tray. Either test protein sample or control sample was applied topically to the diet. After the samples had thoroughly dried, wells were infested with 10 larvae per well. The wells were then covered with a sealable lid and the trays were incubated at 27° C. in the dark. Mortality and stunting were evaluated at 5 and 7 days after infestation, and surviving larvae were weighed (Table 4).

Figure 2:
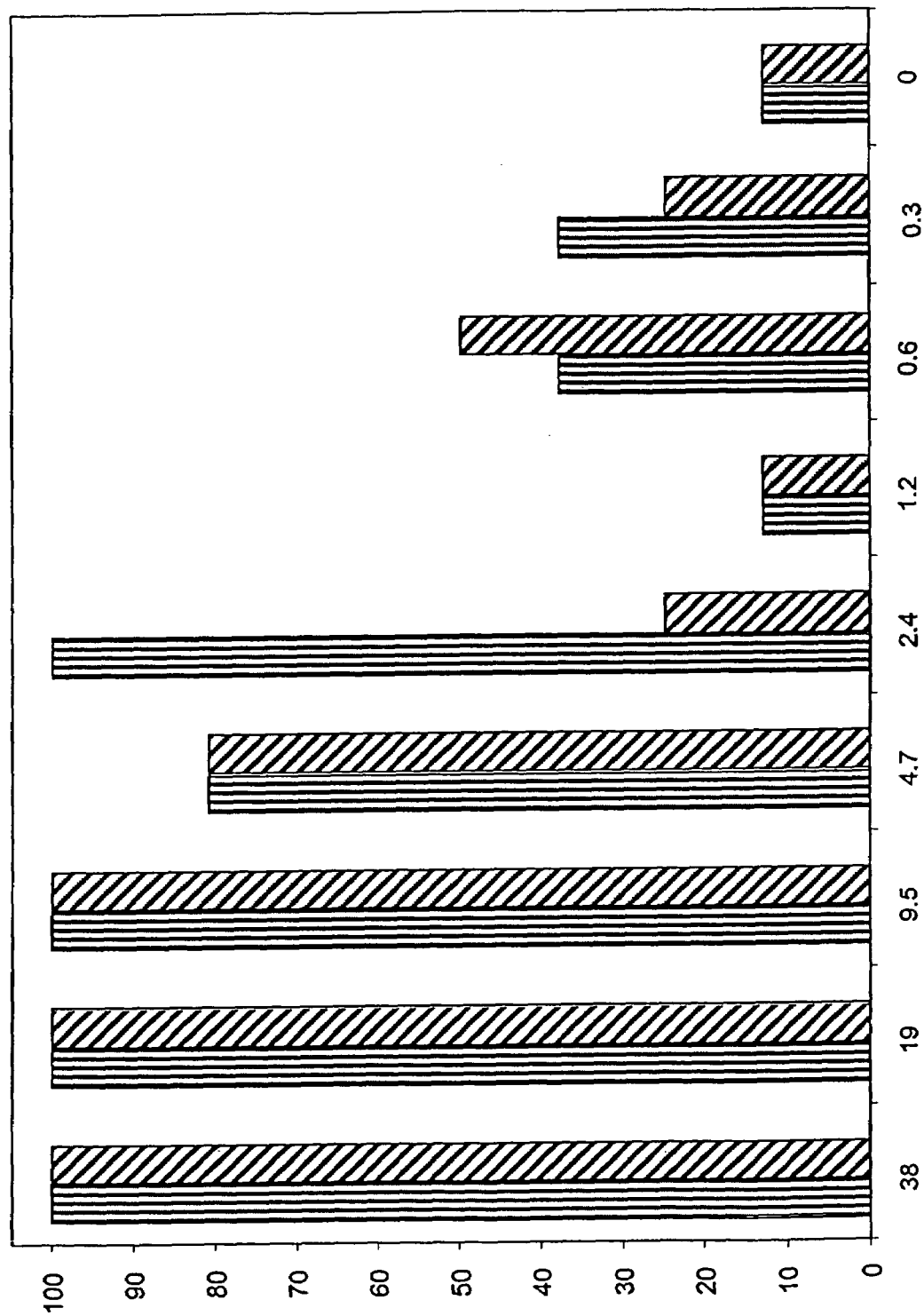
Figure 3:
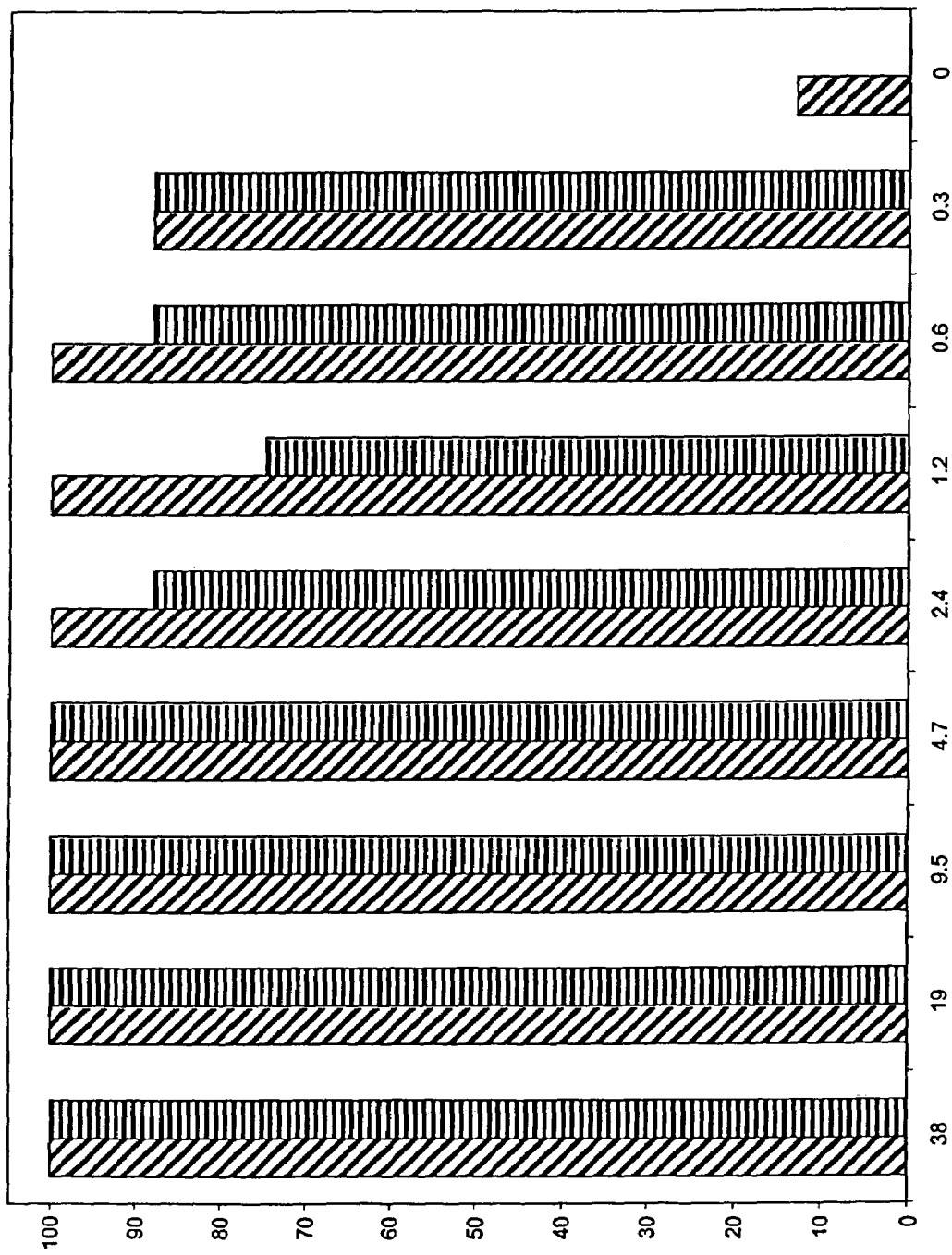
Figure 4:
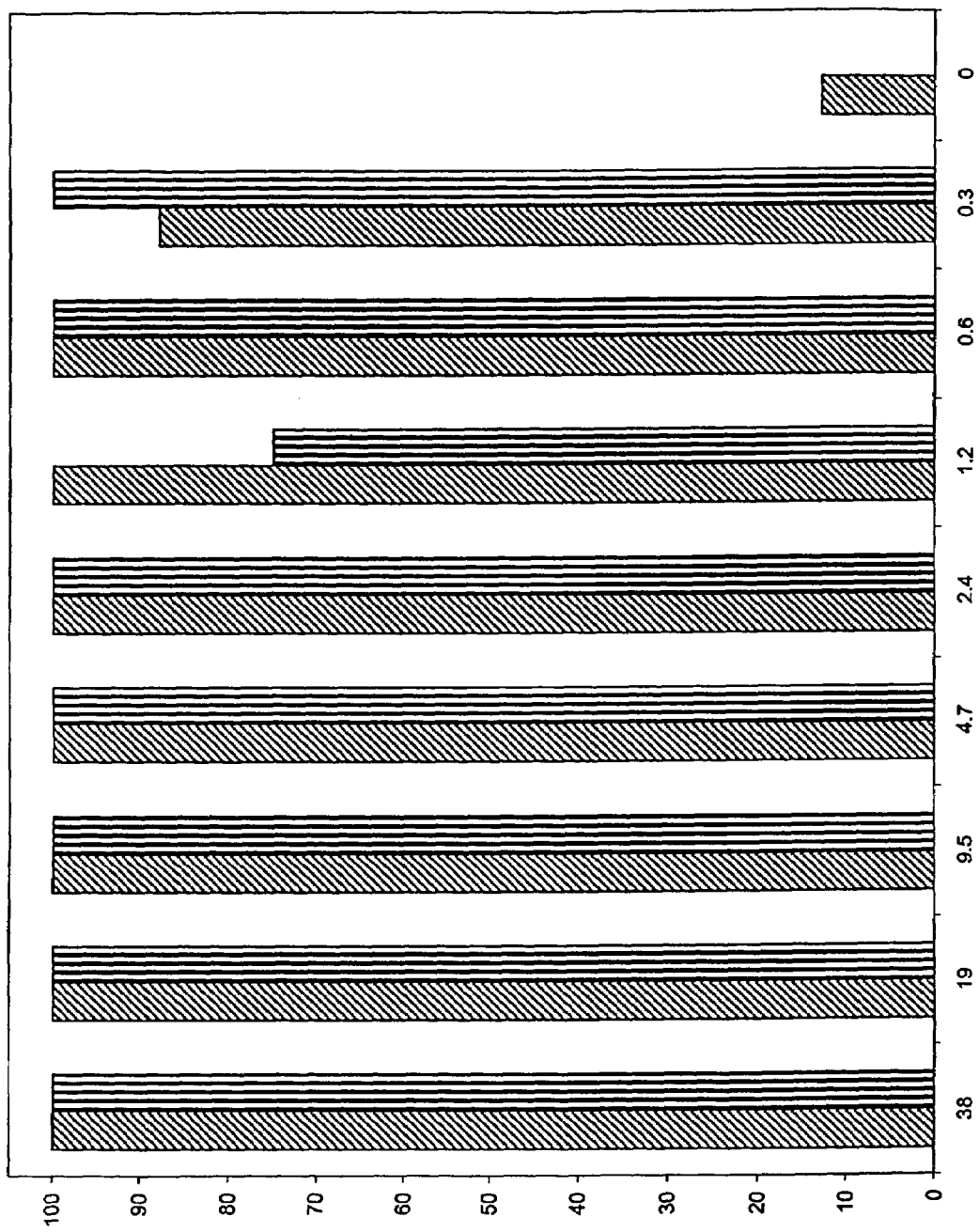

Similar tests were conducted for the Colorado potato beetle (CPB). CPB neonates were infested at a rate of one per well; the test was scored after 6 days and percent mortality for each rate was calculated. Results (shown in FIGS. 2–4) indicate that CPB larvae are much more susceptible to mutant endotoxins K03 and K34 relative to the wild type endotoxin (1218-1). Further, survivors that fed on diets treated with K03 and K34 endotoxin were severely stunted as compared to buffer controls, while CPB survivors from the 1218-1 test were relatively large.

TABLE 4

Initial Results of WCRW Bioassays

| | Samples | [PROTEIN] | 5-day SCORE | 7-day SCORE | 5-day % MORTALITY | 7-day % MORTALITY |
|---|---|---|---|---|---|---|
| | | | WCRW Test # 1 | | | |
| 1 | Buffer | | 6/40 | 6/40 | 15 | 15 |
| 2 | 1218 | 132 µg/cm² | 4/40 | 4/40 | 10 | 10 |
| 3 | NGSR | 132 µg/cm² | 22/40 | 23/40 | 55 | 57 |
| 4 | M6 | 132 µg/cm² | 38/40 | 40/40 | 95 | 100 |

TABLE 4-continued

Initial Results of WCRW Bioassays

| | Samples | [PROTEIN] | 5-day SCORE | 7-day SCORE | 5-day % MORTALITY | 7-day % MORTALITY |
|---|---|---|---|---|---|---|
| | | | WCRW Test # 2 | | | |
| 1 | Buffer | | 4/40 | 5/40 | 10 | 12 |
| 2 | 1218 | 132 µg/cm² | 7/40 | 7/40 | 17 | 17 |
| 3 | NGSR | 132 µg/cm² | 24/40 | 26/40 | 62 | 65 |
| 4 | M6 | 132 µg/cm² | 31/40 | 35/40 | 78 | 88 |

EXAMPLE 9

$LC_{50}$ Determination of Cry8 Like Mutants

A bioassay experiment was conducted to determine the $LC_{50}$ of a Cry8-like mutant M6 for western corn rootworm (WCRW) neonates. These bioassays were conducted essentially as set forth in Example 8. Five observations were made per treatment level (Table 5). Three WCRW neonates were added to each well for a total of 15 larvae/dose. Percent mortality was scored after 5 days of incubation at 27° C. PROBIT analysis (SAS/STAT Users Guide Version 8 Chapter 54, 1999) was used to calculate the lethal concentration of sample at which 50% of the larvae died (i.e., the $LC_{50}$).

The summary of the dose-mortality response of WCRW neonates for this experiment is shown in Table 6. Probit analysis was performed and the result indicated that the $LC_{50}$ of the Cry8-like mutant M6 protein was 26 µg/cm², with 95% fiducial limits at 17.1 and 37.0.

TABLE 5

M6 Protein Samples Used in $LC_{50}$ Bioassays

| Sample Stock Concentration (mg/ml) | Sample Concentration on Diet (µg/cm²) |
|---|---|
| 2.44 | 244 |
| 1.22 | 122 |
| 0.610 | 61 |
| 0.305 | 30.5 |
| 0.153 | 15.3 |
| 0.076 | 7.6 |
| 0.038 | 3.8 |

TABLE 6

Percent Mortality of WCRW Larvae at Various Concentrations of M6 Protein

| Protein Concentration on Diet Surface (µg/cm²) | Trial 1 | Trial 2 | Trial 3 | Trial 4 | Trial 5 | Trial 6 |
|---|---|---|---|---|---|---|
| 244 | 100 | 100 | 100 | 93 | 80 | 80 |
| 122 | 47 | 93 | 40 | 53 | 100 | 53 |
| 61 | 83 | 79 | 67 | 47 | 73 | 57 |
| 30.5 | 53 | 79 | 40 | 13 | 67 | 21 |
| 15.3 | 27 | 40 | 33 | 33 | 73 | 8 |
| 7.6 | 53 | 27 | 53 | 20 | 81 | 14 |
| 3.8 | ND | ND | 0 | 27 | 75 | 25 |
| 0 (buffer) | 7 | 7 | 0 | 7 | 20 | 0 |

(ND = no data)

Probit analysis of the above data indicated that the $LC_{50}$ of the M6 protein corresponded to a concentration of 26

μg/cm$^2$, with 95% fiducial limits at 17.1 and 37.0. A graph of the larval mortality rate as a function of the log of the concentration of M6 protein is shown in FIG. 1.

EXAMPLE 10

Transformation of Maize by Particle Bombardment and Regeneration of Transgenic Plants Immature maize embryos from greenhouse donor plants are bombarded with a DNA molecule containing the plant-optimized Cry1218-1 nucleotide sequence (SEQ ID NO:5) operably linked to a ubiquitin promoter and the selectable marker gene PAT (Wohlleben et al. (1988) *Gene* 70:25–37), which confers resistance to the herbicide Bialaphos. Alternatively, the selectable marker gene is provided on a separate DNA molecule. Transformation is performed as follows. Media recipes follow below.

Preparation of Target Tissue

The ears are husked and surface sterilized in 30% Clorox™ bleach plus 0.5% Micro detergent for 20 minutes, and rinsed two times with sterile water. The immature embryos are excised and placed embryo axis side down (scutellum side up), 25 embryos per plate, on 560Y medium for 4 hours and then aligned within the 2.5-cm target zone in preparation for bombardment.

Preparation of DNA

A plasmid vector comprising a plant-optimized Cry8-like nucleotide sequence (e.g., Cry1218-1, SEQ ID NO:5) operably linked to a ubiquitin promoter is made. For example, a suitable transformation vector comprises a UBI1 promoter from *Zea mays*, a 5' UTR from UBI1 and a UBI1 intron, in combination with a PinII terminator. The vector additionally contains a PAT selectable marker gene driven by a CAMV35S promoter and includes a CAMV35S terminator. Optionally, the selectable marker can reside on a separate plasmid. A DNA molecule comprising a Cry8-like nucleotide sequence as well as a PAT selectable marker is precipitated onto 1.1 μm (average diameter) tungsten pellets using a $CaCl_2$ precipitation procedure as follows:

100 μl prepared tungsten particles in water

10 μl (1 μg) DNA in Tris EDTA buffer (1 μg total DNA)

100 μl 2.5 M $CaCl_2$

10 μl 0.1 M spermidine

Each reagent is added sequentially to a tungsten particle suspension, while maintained on the multitube vortexer. The final mixture is sonicated briefly and allowed to incubate under constant vortexing for 10 minutes. After the precipitation period, the tubes are centrifuged briefly, liquid removed, washed with 500 ml 100% ethanol, and centrifuged for 30 seconds. Again the liquid is removed, and 105 μl 100% ethanol is added to the final tungsten particle pellet. For particle gun bombardment, the tungsten/DNA particles are briefly sonicated and 10 μl spotted onto the center of each macrocarrier and allowed to dry about 2 minutes before bombardment.

Particle Gun Treatment

The sample plates are bombarded at level #4 in particle gun #HE34-1 or #HE34-2. All samples receive a single shot at 650 PSI, with a total of ten aliquots taken from each tube of prepared particles/DNA.

Subsequent Treatment

Following bombardment, the embryos are kept on 560Y medium for 2 days, then transferred to 560R selection medium containing 3 mg/liter Bialaphos, and subcultured every 2 weeks. After approximately 10 weeks of selection, selection-resistant callus clones are transferred to 288J medium to initiate plant regeneration. Following somatic embryo maturation (2–4 weeks), well-developed somatic embryos are transferred to medium for germination and transferred to the lighted culture room. Approximately 7–10 days later, developing plantlets are transferred to 272V hormone-free medium in tubes for 7–10 days until plantlets are well established. Plants are then transferred to inserts in flats (equivalent to 2.5" pot) containing potting soil and grown for 1 week in a growth chamber, subsequently grown an additional 1–2 weeks in the greenhouse, then transferred to classic 600 pots (1.6 gallon) and grown to maturity. Plants are monitored and scored for expression of the Cry1218-1 protein by assays known in the art, such as, for example, immunoassays and western blotting with an antibody that binds to the Cry1218-1 protein.

Bombardment and Culture Media

Bombardment medium (560Y) comprises 4.0 g/l N6 basal salts (SIGMA C-1416), 1.0 ml/l Eriksson's Vitamin Mix (1000×SIGMA-1511), 0.5 mg/l thiamine HCl, 120.0 g/l sucrose, 1.0 mg/l 2,4-D, and 2.88 g/l L-proline (brought to volume with dI $H_2O$ following adjustment to pH 5.8 with KOH); 2.0 g/l Gelrite™ (added after bringing to volume with dI $H_2O$); and 8.5 mg/l silver nitrate (added after sterilizing the medium and cooling to room temperature). Selection medium (560R) comprises 4.0 g/l N6 basal salts (SIGMA C-1416), 1.0 ml/l Eriksson's Vitamin Mix (1000× SIGMA-1511), 0.5 mg/l thiamine HCl, 30.0 g/l sucrose, and 2.0 mg/l 2,4-D (brought to volume with dI $H_2O$ following adjustment to pH 5.8 with KOH); 3.0 g/l Gelrite™ (added after bringing to volume with dI $H_2O$); and 0.85 mg/l silver nitrate and 3.0 mg/l Bialaphos (both added after sterilizing the medium and cooling to room temperature).

Plant regeneration medium (288J) comprises 4.3 g/l MS salts (GIBCO 11117-074), 5.0 ml/l MS vitamins stock solution (0.02 g nicotinic acid, 0.02 g/l thiamine HCl, 0.10 g/l pyridoxine HCl, and 0.40 g/l Glycine brought to volume with polished D-I $H_2O$) (Murashige and Skoog (1962) *Physiol. Plant.* 15:473), 100 mg/l myo-inositol, 0.5 mg/l zeatin, 60 g/l sucrose, and 1.0 ml/l of 0.1 mM abscisic acid (brought to volume with polished dI $H_2O$ after adjusting to pH 5.6); 3.0 g/l Gelrite™ (added after bringing to volume with dI $H_2O$); and 1.0 mg/l indoleacetic acid and 3.0 mg/l Bialaphos (added after sterilizing the medium and cooling to 60° C.). Hormone-free medium (272V) comprises 4.3 g/l MS salts (GIBCO 1117-074), 5.0 ml/l MS vitamins stock solution (0.100 g/l nicotinic acid, 0.02 g/l thiamine HCl, 0.10 g/l pyridoxine HCl, and 0.40 g/l Glycine brought to volume with polished dI $H_2O$), 0.1 g/l myo-inositol, and 40.0 g/l sucrose (brought to volume with polished dI $H_2O$ after adjusting pH to 5.6); and 6 g/l Bacto-agar (added after bringing to volume with polished dI $H_2O$), sterilized and cooled to 60° C.

EXAMPLE 11

*Agrobacterium*-Mediated Transformation of Maize and Regeneration of Transgenic Plants For *Agrobacterium*-mediated transformation of maize with a plant-optimized Cry1218-1 nucleotide sequence (SEQ ID NO: 5), preferably the method of Zhao is employed (U.S. Pat. No. 5,981,840, and PCT patent publication WO98/32326; the contents of which are hereby incorporated by reference). Briefly, immature embryos are isolated from maize and the embryos contacted with a suspension of Agrobacterium under conditions whereby the bacteria are capable of transferring the plant-optimized Cry1218-1 nucleotide sequence (SEQ ID NO:5) to at least one cell of at least one of the immature embryos (step 1: the infection step). In this step the immature embryos are preferably immersed in an Agrobacterium suspension for the initiation of inoculation. The embryos are co-cultured for a time with the Agrobacterium (step 2: the co-cultivation step). Preferably the immature embryos are cultured on solid medium following the infection step. Following this co-cultivation period an optional "resting" step is contemplated. In this resting step, the embryos are incubated in the presence of at least one antibiotic known to inhibit the growth of Agrobacterium without the addition of a selective agent for plant transformants (step 3: resting step). Preferably the immature embryos are cultured on solid medium with antibiotic, but without a selecting agent, for elimination of Agrobacterium and for a resting phase for the infected cells. Next, inoculated embryos are cultured on medium containing a selective agent and growing transformed callus is recovered (step 4: the selection step). Preferably, the immature embryos are cultured on solid medium with a selective agent resulting in the selective growth of transformed cells. The callus is then regenerated into plants (step 5: the regeneration step), and preferably calli grown on selective medium are cultured on solid medium to regenerate the plants.

EXAMPLE 12

Dose-Response Bioassay for Mutant Endotoxins Against the Boll Weevil, Anthonomus grandis Treatments:

Four endotoxins were tested by diet incorporation for activity against the boll weevil, Anthonomus grandis, obtained from USDA APHIS PPQ MPPC Insect Production; Moore Air Base, Bldg. S-6414 Mission, Tex.: wild type (1218-1); K03 mutant endotoxin; M6 mutant endotoxin; and K40 mutant endotoxin. Controls included buffer alone and untreated diet.

Method:

Five 24-well plates were set up for each treatment, and 200 ml Bioserv boll weevil diet (#F9247B) was prepared according to manufacturer's specifications. The diet was held in a 40° C. water bath.

A serial dilution of the endotoxin samples was prepared in microfuge tubes using sample aliquots of 3 mg, 1.5 mg, 0.75 mg, 0.37 mg, 0.19 mg. 5 ml of diet was removed from the water bath and placed in a scintillation vial. A protein sample was then added to the diet and mixed thoroughly. After mixing with 5 ml of diet the resulting concentrations were 600, 300, 150, 75, and 37 µg/ml diet (these rates were chosen to correspond to topical rates of 100, 50, 25, 12.5, and 6.25 µg/cm².) 150 microliters of diet was added to four wells of each of the five 24-well plates. Each plate had the following configuration:

TABLE 7

Configuration of Test Plates

| 600 | 300 | 150 | 75 | 37 | Blank |
| 600 | 300 | 150 | 75 | 37 | Blank |
| 600 | 300 | 150 | 75 | 37 | Blank |
| 600 | 300 | 150 | 75 | 37 | Blank |

Controls included a single plate of buffer treatment, which was produced with all 24 wells receiving 500 microliters of buffer. Another control plate was produced with no addition to the diet. The M6 mutant endotoxin amino acid sequence is set forth in SEQ ID NO:70; the K03 mutant endotoxin amino acid sequence is set forth in SEQ ID NO:68; and the K40 mutant endotoxin amino acid sequence is set forth in SEQ ID NO:94.

Results:

One week after boll weevil infestation, boll weevil larvae were recovered from the diet plugs of all 5 plates containing the same Cry8-like mutant and combined. The diet pills were carefully dissected under 4x magnification in order to recover all larvae.

TABLE 8

Results of Bioassay on Boll Weevil Larvae

| Protein Concentration (ug/ml diet) | 1218-1 | M6 | K03 | K40 | Buffer (500 ul/well) |
|---|---|---|---|---|---|
| 600 | 5ss | 4s | 0 | 3ss | 4 + 1s |
| 300 | 3ss | 6s | 0 | 1ss | 5 + 1ss |
| 150 | 2s | 7s | 3s | 3ss | 3 + 1ss |
| 75 | 2 | 9 | 3s | 3ss | 2 + 4s |
| 38 | 3 | 11 | 2s | 3ss | 4 + 1s |

(s= stunted;
ss= severely stunted).

EXAMPLE 13

Second Dose-Response Bioassay for Mutant Endotoxins Against the Boll Weevil, Anthonomus grandis An examination of the effect of wild type endotoxin (1218-1) and two endotoxin mutant proteins (M6 and K03) on total biomass using a high and low dose of toxin shows that the mutants have enhanced pesticidal activity relative to the wild type endotoxin. Results are shown in Table 8.

Bioassays were conducted as described in Example 12, with the following modifications. Three replicate plates were produced for each sample with four observations per dose per plate.

Results were scored at 96 hours post-emergence, when larvae were recovered from the diet, counted, and weighed. All larvae from a particular treatment plate were weighed together this number was divided by the number of individuals to give an average weight.

TABLE 9

Effect of Endotoxins on Cotton Boll Weevil Larval Weight

| Endotoxin | Larval weight (mg) on 600 µg/ml diet | Larval weight (mg) on 19 µg/ml diet |
|---|---|---|
| 1218-1 | 9.00 | 42.23 |
| K03 | 0.00 | 14.70 |
| M6 | 4.07 | 30.60 |
| Buffer (control) | 79.10 | 84.40 |

Figure 5:
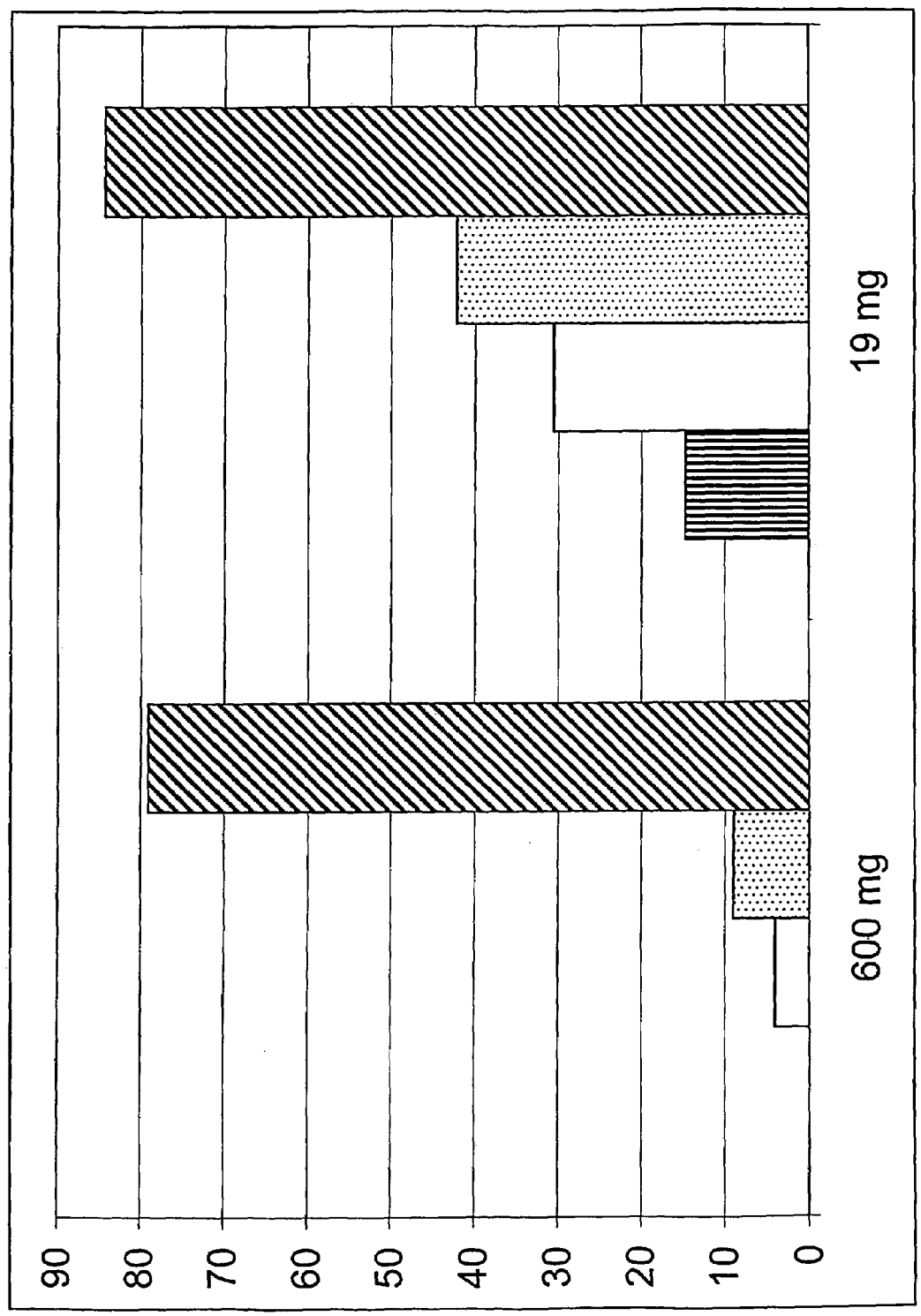

(These results are also shown graphically in FIG. 5).

Thus, at the highest endotoxin dose of 600 µg per ml of diet, 1218-1 and M6 treatments show a very significant reduction in biomass of 88.6% and 94.9%, respectively. These data represent an 8.80 and 19.4 fold increase in activity for 1218 and M6, respectively, when compared to buffer control. Treatment with K03 protein yielded no survivors at the 600 μg treatment in any of the replicates.

In comparison, at the lowest dose of 19 μg per ml of diet, the data indicate a 50.0%, 63.7%, and 82.6% reduction in biomass for 1218, M6 and K03, respectively, when compared to the buffer control. Thus, at a dose that is over 30 fold lower, the K03 mutation at 19 μg per ml of diet exhibits nearly equivalent activity (82.6% reduction in biomass) when compared to wild type endotoxin (1218) at 600 μg per ml of diet (88.6% reduction in biomass). Furthermore, at a dose of 19 μg per ml of diet, K03 endotoxin shows activity that is 2.08 and 2.87 fold better activity than the M6 and wild type (1218-1) endotoxins, respectively.

Explanation of Results:

The data indicate a clear reduction in weight for all polypeptide samples when compared to the buffer control. Additionally, all mutant endotoxins reduced larval growth below the growth seen for the native or wild type (1218-1) endotoxin. The mutants K03, K35, and K40 produced results of few or no larvae recovered at the highest doses and a high degree of stunting at lower doses. The K40 mutant protein produced an approximately 5-fold reduction in weight gain at the highest doses when compared to wild type endotoxin. When compared to the buffer control, the K40 mutant produced reductions ranging from 46 fold at the highest dose to 5 fold at the lowest dose based on comparison of average larval weights at those doses. Similarly, results for the K03 mutant showed effects ranging from complete mortality at the highest dose to 200-fold weight reduction at the next dose and 5-fold weight reduction at the lowest dose. The K35 mutant showed a pattern similar to that of the K03 mutant.

EXAMPLE 14

Bioassay for Testing the Pesticidal Activity of Mutant Cry8-like K03 Polypeptide Against Corn Flea Beetle (*Chaetocnema pulicaria*)

A bioassay experiment was conducted to determine if corn flea beetles (*Chaetocnema pulicaria*) are susceptible to the mutant K03 endotoxin (SEQ ID NO:68). Since corn leaf beetles feed predominately on the upper layer of leaf cells, a known amount of toxin may be applied to the leaf surface or leaves may be coated with toxin by dipping. Insects are then allowed to feed on toxin treated leaves and after a prescribed time period, percent mortality can be calculated.

For this assay, corn flea beetles were field collected and presented with leaf discs that were dipped in either a K03 or buffer solution. Leaf discs were evaluated in a 128-well CD International bioassay tray (catalog number BIO-BA-128 from CD International, Pitman, N.J. 08071) in which each well was first filled with 1 ml molten agar solution. Once the agar solidified, a 1.5 cm filter paper (VWR, catalog number 28309-989) was placed on top of the agar plug and wetted with 25 μl of sterile water. Next, leaf discs (1 cm diameter) were punched from whorl leaves (collected from V8 stage corn plants) and dipped in either in a K03 (1 mg /ml) solution or a 20 mM sodium carbonate (pH 10.5) buffer solution. Both solutions contained 0.01% Tween 20 to aid in the dispersal of sample over the entire leaf surface. Once the wetted dipped leaf discs dried, they were placed on top of the filter paper in the bioassay tray so that 1 disc was present per well in the 128 well bioassay tray. Each well was then infested with one corn flea beetle and covered with sealable lids supplied by CD International, Pitman, N.J. 08071. The assay was scored after 5 days and percent mortality was calculated.

Examination of leaf discs after 5 days showed moderate levels of feeding damage as noted by the presence of thin brown stripes on both K03 and buffer treated leaves. It was observed that a greater number of corn flea beetles died after they fed on leaf discs treated with K03 as compared to those that fed on buffer treated leaf discs (see Table 10).

TABLE 10

Corn flea beetle bioassay results.

| Treatment | Mortality (%) |
|---|---|
| Buffer | 14/32 = 44 |
| K03 | 23/31 = 74 |

EXAMPLE 15

Modification of GC Content to Create Optimized Nucleotide Sequences

Analysis of Coding Regions from Various Organisms

Figure 8:
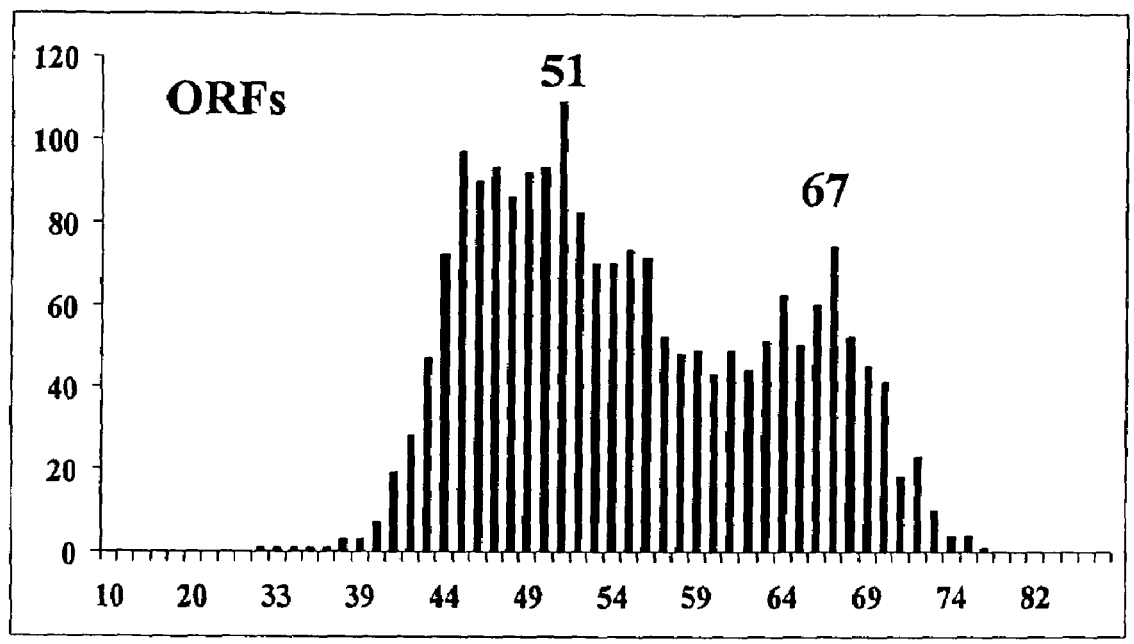
Figure 8:
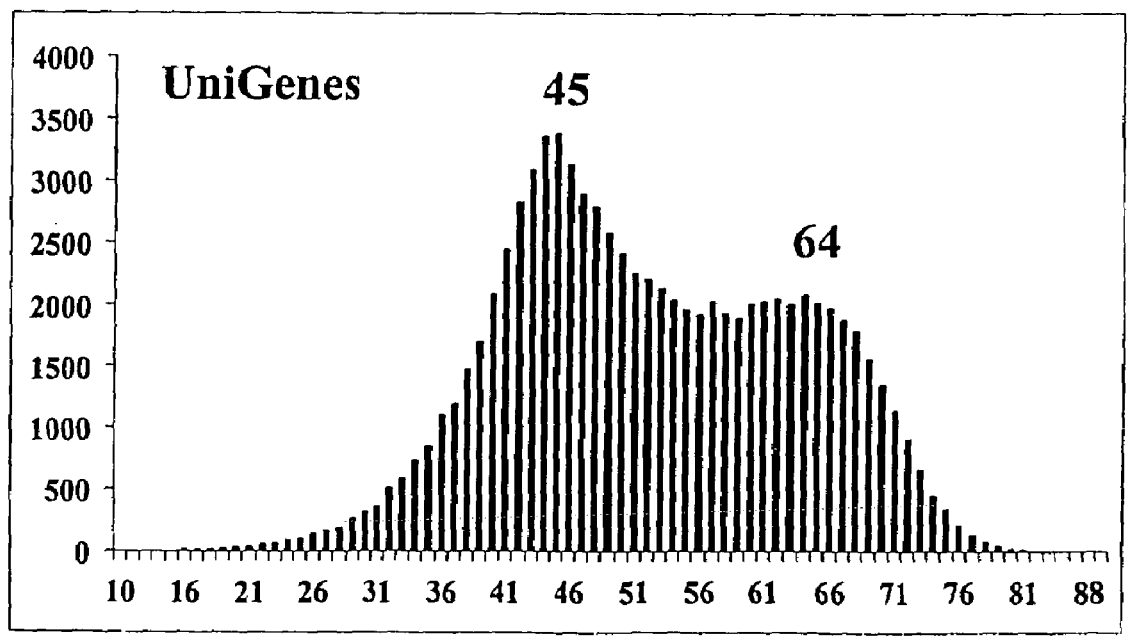

A dataset containing 1831 maize cDNAs with full-length coding regions were plotted versus GC content of the coding sequence (FIG. 8, "ORFs" shown in upper panel). The plot showed a bimodal distribution with the majority of sequences (about ⅔) in the low GC mode peaked at about 51% GC and about a third in the high GC mode peaked at about 67% GC.

While this is the largest set of maize full-length cDNAs so analyzed to date, based on a total gene count estimate of 50,000, this dataset may only represent about 3.6% of the transcriptome. Consequently, an EST-based UniGene assembly sequence dataset believed to represent most maize genes and containing 84,085 sequences was also analyzed (FIG. 8, "UniGenes" shown in lower panel). As used herein, a Unigene represents a consensus sequence of assembled Est's. The Unigene dataset results from an application of the CAP3 assembly algorithm (see Huang and Madan (1999) *Genome Research* 9:868–877). The analysis of this dataset confirmed the earlier full-length cDNA results by showing a bimodal distribution with a similar proportion of high and low GC genes. The bimodal distribution for the UniGene dataset was centered at 45% and 64% GC, slightly lower than for the smaller full-length cDNA dataset, probably due to the inclusion of remaining untrimmed AT-rich 3'-UTR non-coding sequences.

The GC analysis was performed for other plants. A corresponding survey of coding regions (i.e., cDNA "ORFs," or Open Reading Frames) revealed very similar bimodal distributions for rice and wheat (2,400 rice sequences and 800 wheat sequences were analyzed). In contrast, analysis of *Arabidopsis* (25,700 sequences), *Solanaceae* ssp. (2,000 sequences), and soybean (*G. max,* 400 cDNAs, or 49,300 UniGene assemblies), all revealed single mode distributions with peaks between 42–44% GC content.

In an examination of other organisms, a survey of cDNA ORFs from warm-blooded mammals all revealed broad GC content distributions with suggested bimodality. In this analysis, 19,200 sequences were analyzed from human, 12,000 from mouse (*M. musculus*), 900 from cattle (*B. taurus*), and 1,100 from chicken (*G. gallus*). An examination of organisms from other major eukaryotic groups showed unimodal distributions with peaks ranging from 38%–56%

GC content for *C. elegans* (16,000 sequences analyzed), *D. melanogaster* (14,800 sequences), and *S. cereviseae* (6,300 sequences). Unimodal distributions were also found for sequences from three eubacteria (*E. coli*, 4,200 sequences; *B. subtilus*, 4,000 sequences; *Synechocystis* sp. 3,200 sequences) and four Archaea (*T. maritima*, 1,800 sequences; *T. jannaschii*, 1,800 sequences; *A. fulgidus*, 2,400 sequences; *H. halobium*, 2,600 sequences (with very high overall GC content).

Thus, a broad survey of GC content distribution showed that, in contrast to most organisms, monocot cereals have a clearly bimodal GC content distribution. Warm-blooded vertebrates also showed a bimodal tendency, but this was less pronounced than in monocots.

mRNA Profiling

To examine the relationship between gene expression and GC content, mRNA expression of high (centered at approximately 67% GC content) and low (centered at approximately 51% GC content) GC mode maize genes was investigated using both EST distribution analysis (over 400,000 ESTs) and Lynx MPSS technology (63.4 million 17-mer tags) (see Brenner et al. (2000) *Nature Biotechnology* 18:630–634, Brenner et al. (2000) *PNAS* 97:1665–1670 for information on Lynx MPSS). The data showed that while gene expression varied widely within high and low GC modes, when the average expression levels among 12 key distinct tissue categories were considered, the overall average expression level of high and low GC mode genes in maize was similar.

EXAMPLE 16

Method of Optimizing GC Content of Genes

In light of the findings about GC content described above, it was of interest to develop computerized methods to modify coding sequences of any gene from any source organism into a structure compatible with that preferred by maize and other cereals. As discussed above, other major cereals such as wheat and rice show similar bimodal distributions to maize, and the high GC preferred codons are the same. Consequently, the methods for sequence optimization described below would be useful not only for enhanced gene expression in maize but also in all the cereals. These methods allow coding sequences from various organisms to be optimized for expression in cereals and in this manner provide for improved transgenic plants, for example, a crop plant such as maize. Two exemplary optimization methods are presented below. However, it is recognized that one of skill in the art would be able to optimize a sequence using a variety of procedures and still create a sequence of the invention.

Method 1: Dialed-in GC Content

This method allows selection and generation of an altered nucleotide sequence containing a specified percentage of GC content (within 0.5%). This method employs proportional codon usage frequencies and takes into account the tendency of coding regions to have a gradient of GC content from 5' to 3' end. The proportional codon usage frequencies are arrayed in weighted tables to implement the method.

Step 1. Determine whether the selected GC content is theoretically feasible.

First, the theoretical highest and lowest GC content are calculated for the sequence of interest. In this step, codon substitutions are made in the original sequence to generate altered sequences with the highest and lowest possible GC content that still encode the same polypeptide as the original sequence. The original sequence may of course be a coding sequence or predicted polypeptide from any source.

Where there are two codons that are equally GC-poor, the codons are substituted in proportion according to the low GC mode proportional codon tables (see Table 11, GC-Richest and Poorest Proportional Codon Table, Proportional Codon Frequency Columns (on left)). For example, the GC-poor codons corresponding to alanine include both GCT and GCA. From the low GC mode proportional codon table, the relative frequencies of GCA and GCT are 30.4% and 36.5%, respectively. Thus, in proportion with their relative frequencies, for low GC mode substitution, the GCA substitution frequency should be 30.4/(36.5+30.4)=45.4% and the GCT substitution frequency should be 36.5/(36.5+30.4)= 55.6%. These percentages have been calculated and are presented in Table 11, Proportional Extreme GC Columns/ Lowest GC (on right). Thus, for low GC mode, GCA should be substituted for 45.4% of the alanine codons and GCT for 55.6% of the alanine codons Similarly, for determining the highest possible GC content, substitution frequencies are presented in Table 11, Proportional Extreme GC Columns/Highest GC. Thus, for alanine, the high GC content codons are GCC and GCG, which are found at frequencies of 47.2% and 38.7% overall, respectively. Thus, in high GC mode, the GCC codon is substituted for 54.9% of alanine codons [47.2/(47.2+38.7)= 54.9%] and the GCT codon is substituted for 45.1% of alanine codons [38.7/47.2+38.7)=45.1%].

In this manner, two new altered nucleotide sequences are created, one with the lowest possible GC content and the other with the highest possible GC content, according to the proportional codon usage of Table 11. These altered nucleotide sequences still encode the same polypeptide as the original nucleotide sequence. In a computer program written to implement this algorithm, if the desired GC content is at or outside these high and low GC content values, the program can output the altered nucleotide sequence for the higest and lowest GC content. One characteristic of this method is that in the altered sequence, the codons for any given amino acid may not be uniformly distributed and there could be block stretches of the same codon for a particular amino acid.

TABLE 11

| | GC-Richest and Poorest Proportional Codon Table | | | | | |
|---|---|---|---|---|---|---|
| | | Proportional Codon Frequency | | | Proportional Extreme GC | |
| Amino acid | Codon | General | High GC | Low GC | Highest GC | Lowest GC |
| Ala | GCA | 19.88% | 5.96% | 30.38% | | 45.43% |
| | GCC | 32.00% | 47.20% | 20.61% | 54.93% | |

TABLE 11-continued

GC-Richest and Poorest Proportional Codon Table

| Amino acid | Codon | Proportional Codon Frequency | | | Proportional Extreme GC | |
|---|---|---|---|---|---|---|
| | | General | High GC | Low GC | Highest GC | Lowest GC |
| | GCG | 22.83% | 38.72% | 12.51% | 45.07% | |
| | GCT | 25.29% | 8.13% | 36.49% | | 54.56% |
| Arg | AGA | 16.20% | 3.57% | 24.18% | | 100.00% |
| | AGG | 25.71% | 22.04% | 26.57% | | |
| | CGA | 7.82% | 3.43% | 10.24% | | |
| | CGC | 23.11% | 40.18% | 13.28% | 61.20% | |
| | CGG | 15.94% | 25.47% | 11.56% | 38.80% | |
| | CGT | 11.22% | 5.31% | 14.17% | | |
| Asn | AAC | 60.68% | 92.55% | 46.57% | 100.00% | |
| | AAT | 39.32% | 7.45% | 53.43% | | 100.00% |
| Asp | GAC | 55.30% | 90.32% | 37.75% | 100.00% | |
| | GAT | 44.70% | 9.68% | 62.25% | | 100.00% |
| Cys | TGC | 67.97% | 92.08% | 54.31% | 100.00% | |
| | TGT | 32.03% | 7.92% | 45.69% | | 100.00% |
| Gln | CAA | 34.97% | 9.41% | 47.49% | | 100.00% |
| | CAG | 65.03% | 90.59% | 52.51% | 100.00% | |
| Glu | GAA | 34.46% | 9.55% | 46.37% | | 100.00% |
| | GAG | 65.54% | 90.45% | 53.63% | | |
| | | | | 100.00% | | |
| Gly | GGA | 20.26% | 7.62% | 28.39% | | 48.83% |
| | GGC | 37.85% | 62.57% | 23.22% | 72.82% | |
| | GGG | 20.48% | 23.35% | 18.65% | 27.18% | |
| | GGT | 21.41% | 6.45% | 29.74% | | 51.16% |
| His | CAC | 56.40% | 87.35% | 40.16% | 100.00% | |
| | CAT | 43.60% | 12.65% | 59.84% | | 100.00% |
| Ile | ATA | 19.32% | 4.90% | 24.91% | | 37.25% |
| | ATC | 48.33% | 88.53% | 33.13% | 100.00% | |
| | ATT | 32.34% | 6.57% | 41.96% | | 62.75% |
| Leu | CTA | 8.04% | 2.73% | 10.82% | | |
| | CTC | 25.61% | 44.16% | 15.63% | 50.06% | |
| | CTG | 27.10% | 44.05% | 19.29% | 49.94% | |
| | CTT | 18.24% | 4.61% | 24.48% | | |
| | TTA | 6.63% | 0.54% | 10.18% | | 100.00% |
| | TTG | 14.37% | 3.91% | 19.59% | | |
| Lys | AAA | 28.98% | 7.57% | 39.06% | | 100.00% |
| | AAG | 71.02% | 92.43% | 60.94% | 100.00% | |
| Met | ATG | 100.00% | 100.00% | 100.00% | 100.00% | 100.00% |
| | TTC | 64.74% | 94.80% | 50.08% | 100.00% | |
| Phe | TTT | 35.26% | 5.20% | 49.92% | | 100.00% |
| Pro | CCA | 26.66% | 10.21% | 36.80% | | 51.94% |
| | CCC | 22.07% | 31.91% | 15.40% | 40.09% | |
| | CCG | 25.74% | 47.67% | 13.76% | 59.90% | |
| | CCT | 25.53% | 10.21% | 34.05% | | 48.05% |
| STOP | TAA | 30.64% | 24.89% | 33.00% | | 100.00% |
| | TAG | 34.95% | 38.33% | 33.00% | 51.03% | |
| | TGA | 34.41% | 36.78% | 34.00% | 48.97% | |
| Ser | AGC | 21.90% | 32.94% | 16.65% | 37.50% | |
| | AGT | 10.93% | 2.56% | 15.26% | | 25.34% |
| | TCA | 15.95% | 4.23% | 21.75% | | 36.12% |
| | TCC | 20.60% | 31.87% | 14.46% | 36.29% | |
| | TCG | 13.22% | 23.02% | 8.68% | 26.21% | |
| | TCT | 17.40% | 5.38% | 23.20% | | 38.53% |
| Thr | ACA | 23.81% | 5.61% | 34.03% | | 51.40% |
| | ACC | 31.88% | 46.40% | 22.29% | 52.75% | |

TABLE 11-continued

GC-Richest and Poorest Proportional Codon Table

| Amino acid | Codon | Proportional Codon Frequency | | | Proportional Extreme GC | |
|---|---|---|---|---|---|---|
| | | General | High GC | Low GC | Highest GC | Lowest GC |
| | ACG | 20.74% | 41.57% | 11.50% | 47.25% | |
| | ACT | 23.57% | 6.42% | 32.18% | | 48.60% |
| Trp | TGG | 100.00% | 100.00% | 100.00% | 100.00% | 100.00% |
| Tyr | TAC | 63.47% | 94.76% | 47.77% | 100.00% | |
| | TAT | 36.53% | 5.24% | 52.23% | | 100.00% |
| Val | GTA | 9.86% | 2.37% | 14.58% | | 28.73% |
| | GTC | 29.82% | 42.63% | 21.73% | 45.93% | |
| | GTG | 35.25% | 50.19% | 27.52% | 54.07% | |
| | GTT | 25.07% | 4.81% | 36.17% | | 71.27% |

Step 2. If the desired GC content is between the highest and lowest possible GC percentage for the original sequence, the sequence may be altered accordingly.

The altered sequence from step 1 is selected which has GC content closest to the desired GC content. This sequence is then further altered according to the codon usage tables so that the GC content is increased or decreased to the desired level. As an initial step in changing GC content, changing only the third codon positions should be considered. (However, for arginine codons, there could theoretically be changes in the first two codon positions when substituting the preferred low or high GC codon—see Table 12 below). If the GC content needs to be increased, changes may be made from the N-terminal or 5'-end to the C-terminal or 3'-end so as to preserve and even enhance the negative GC gradient in the coding region. Similarly, if the GC content needs to be decreased, changes may be made from the C-terminal or 3'-end to the N-terminal or 5'-end so as to preserve and even enhance the negative GC gradient. Not all amino acid codons will be substituted because some rare codons may be avoided. Among the amino acids and their codons available to change in method 1 are the following:

TABLE 12

Codon Substitutions to Increase or Decrease GC Content

| AA | To Decrease GC | To Increase GC |
|---|---|---|
| Ala | GCT | GCC |
| Arg | AGA | CGC |
| Asn | AAT | AAC |
| Asp | GAT | GAC |
| Gly | GGT | GGC |
| His | CAT | CAC |
| Ile | ATT | ATC |
| Leu | CTT | CTC |
| Pro | CCA | CCG |
| Ser | TCT | AGC |

TABLE 12-continued

Codon Substitutions to Increase or Decrease GC Content

| AA | To Decrease GC | To Increase GC |
|---|---|---|
| Thr | ACA | ACC |
| Val | GTT | GTC |

Results Output

Where a computer program implements the method, the output can include a nucleotide sequence which is the altered sequence according to the method(s) above. This sequence is then translated into a predicted polypeptide which is compared with the polypeptide encoded or predicted to be encoded by the original nucleotide sequence to ensure that, where desired, the polypeptide sequence has not been changed by the alterations in the GC content of the nucleotide sequence.

Method 2 for Optimizing Genes:

Step 1. The first step is the same as described for method 1 except that the appropriate codons are substituted in an alternating pattern, with any excess of one applied to the beginning (i.e., oriented toward the N-terminal), and codons ending in G or C are applied first where possible. As in method 1, two altered sequences are generated that represent the highest and lowest possible GC content for a sequence that (if desired) still encodes the same polypeptide as the original sequence. If the desired GC content is at or outside these theoretical highest and lowest GC content values, the sequence closest to the desired level of GC content is chosen for further alteration.

Step 2. If the desired GC content is between the highest and lowest possible GC percentage for the original sequence, the sequence may be altered accordingly.

The study of the 1831 maize ORFs described in Example 15 revealed patterns in the GC content and codon content of maize genes. The coding regions of maize genes were shown to have an overall GC content of 54.5%, with an overall GC content in the third codon position of 63%. The GC content of the third position varies as a function of relative position in the coding region. Thus, for the first 180 nucleotides (first 60 codons, or roughly first sixth of coding region), the third codon position GC content is 70%. For the second 180 nucleotides (second 60 codons, or roughly second sixth of coding region), the third codon position GC content is 65%. For the remainder of the coding region, the third codon position GC content is about 60%. Thus, in approximately the first 60 codons, the third codon position GC content is 11% higher than the overall GC content; in approximately the second 60 codons, it is 3% higher, and in the remainder of the coding region it is 4.8% lower than the overall GC content.

A scatter plot of the third codon position GC content (designated "ORF3GC") versus the overall GC content (designated "ORFGC") was used to determine the best fitting line to this data using the least squares method. The resulting equation gives the general relationship between ORF3GC and ORFGC for maize genes, as follows: ORF3GC=2.03*ORFGC−47.2. Changes made to the third codon position will generally have an effect on the ORFGC content in a manner according to this equation.

However, the plot of ORF3GC versus ORFGC is actually slightly curved at the ends, especially at the high-end GC levels, where the slope decreases. This decrease in slope is probably the result of amino acid composition biases as well as saturation of GC content in codons that may vary in third position GC content. Thus, unless the above equation is modified, it will generally underestimate the correct ORF3GC value in relation to ORFGC. This is especially true where the overall GC percentage of a sequence is intermediate, a situation in which GC content alteration is particularly likely to be desirable. A computer program was designed and implemented to perform the above methods. After using this program (method 2, also known as "10.2") to apply the methods in equation form and using the above original linear equation, empirical observations permitted correction of the original equation to one that resulted in better correlation of ORF3GC with ORFGC. The resulting modified equation is ORF3GC=2.06*ORFGC−44.2. Thus, changing ORF3GC will be expected to generally cause a concomitant change in the ORFGC.

Given the other information above regarding the tendency towards a negative ORF ORF3GC content gradient, the following equation can be developed.

Let L=length of protein in amino acids or codons

Let B=Base ORF3GC % level to which, for example 11% will be added in first ORF section Let ORF3GC=Overall ORF3GC % of the ORF Let ORFGC=Overall ORFGC % of the ORF Line equation=$ORF3GC=2.06*ORFGC-44.2$ So:

Number 3GC nts=Number 3GC nts in first ORF section+Number 3GCnts in second ORF section+Number 3GC nts in remainder of the ORF Which Equals:

$L*(ORF3GC/100)=60*(B+11)/100+60*(B+3)/100+(L-120)(B-4.8)/100$

Substitute with Line Equation:

$L*(2.06*ORFGC-44.2)/100=60*(B+11)/100+60*(B+3)/100+(L-120)(B-4.8)/100$

Simplify:

$2.06*L*ORFGC-44.2*L=60B+660+60B+180+LB-4.8*L-120B+576$ $2.06*L*ORFGC-44.2*L=1416+LB-4.8*L$ $2.06*L*ORFGC-39.4*L=1416+LB$

Example Solve:

Let Length=300

Let ORFGC=60

Then:

$2.06*300*60-39.4*300=1416+300B$ $37080-11820=1416+300B$ $23844=300B$ $B=79.48$ or 79.48% $ORF3GC$ as the base Therefore the ORF3GC target in the first section will be 90.48, in the second section 82.48, and in the last section approximately 74.68. The ORF3GC target in the last section will be affected by protein length due to limitation of the first two sections to 60 codons each, leaving the remainder of the ORF to the last section. Thus, the number of codons in the last section will vary depending upon the length of the protein. As the described methods are applied to proteins of various lengths, the amount of GC adjustments that are performed in the last section will then be affected by the length of this section.

Step 3. Creation of a template ORF

For the process a "template ORF" or coding sequence is created based on the general maize codon table so that the normal relative proportion of codons is preserved (rounded off to the nearest whole integer). Codons having a G or C in the third position are generally concentrated at the N-terminal or 5' end. Also, codons are distributed such that excess codons are substituted into the 5' or N-terminal of the coding region, followed by an alteration of the codons so as to disperse their location in the protein.

TABLE 13

General Maize Codon Table (1831 seqs)

| Amino acid | Codon | Codon Freq |
|---|---|---|
| Ala | GCA | 19.88% |
|  | GCC | 32.00% |
|  | GCG | 22.83% |
|  | GCT | 25.29% |
| Arg | AGA | 16.20% |
|  | AGG | 25.71% |
|  | CGA | 7.82% |
|  | CGC | 23.11% |
|  | CGG | 15.94% |
|  | CGT | 11.22% |
| Asn | AAC | 60.68% |
|  | AAT | 39.32% |
| Asp | GAC | 55.30% |
|  | GAT | 44.70% |

TABLE 13-continued

General Maize Codon Table (1831 seqs)

| Amino acid | Codon | Codon Freq |
|---|---|---|
| Cys | TGC | 67.97% |
|  | TGT | 32.03% |
| Gln | CAA | 34.97% |
|  | CAG | 65.03% |
| Glu | GAA | 34.46% |
|  | GAG | 65.54% |
| Gly | GGA | 20.26% |
|  | GGC | 37.85% |
|  | GGG | 20.48% |
|  | GGT | 21.41% |
| His | CAC | 56.40% |
|  | CAT | 43.60% |
| Ile | ATA | 19.32% |
|  | ATC | 48.33% |
|  | ATT | 32.34% |
| Leu | CTA | 8.04% |
|  | CTC | 25.61% |
|  | CTG | 27.10% |
|  | CTT | 18.24% |
|  | TTA | 6.63% |
|  | TTG | 14.37% |
| Lys | AAA | 28.98% |
|  | AAG | 71.02% |
| Met | ATG | 100.00% |
| Phe | TTC | 64.74% |
|  | TTT | 35.26% |
| Pro | CCA | 26.66% |
|  | CCC | 22.07% |
|  | CCG | 25.74% |
|  | CCT | 25.53% |
| STOP | TAA | 30.64% |
|  | TAG | 34.95% |
|  | TGA | 34.41% |
| Ser | AGC | 21.90% |
|  | AGT | 10.93% |
|  | TCA | 15.95% |
|  | TCC | 20.60% |
|  | TCG | 13.22% |
|  | TCT | 17.40% |
| Thr | ACA | 23.81% |
|  | ACC | 31.88% |
|  | ACG | 20.74% |
|  | ACT | 23.57% |
| Trp | TGG | 100.00% |
| Tyr | TAC | 63.47% |
|  | TAT | 36.53% |
| Val | GTA | 9.86% |
|  | GTC | 29.82% |
|  | GTG | 35.25% |
|  | GTT | 25.07% |

This template ORF is then used to adjust the original coding sequence to conform to the GC gradient according to the principles outlined above. In this process, the linear equation discussed above is used to calculate the base ORF3GC. In addition, the OFR3GC content is adjusted in view of the increased GC content in the first and second 60-codon regions of the ORF, as discussed above. Thus, the ORF3GC content is adjusted by dividing the template ORF into the three sections: the first 60 codons, the second 60 codons, and the rest of the ORF. For each section, the ORFGC and ORF3GC are determined and compared and alterations made to the original sequence accordingly. Thus, for example, the first 60-codon ORF section is evaluated to determine whether the ORF3GC needs to be raised or lowered. (Often the ORF3GC will need to be raised to be in compliance with the negative GC gradient along the coding sequence). If the ORF3GC needs to be raised, then codon substitutions are made according to Table 11 beginning at the N-terminal end of the section. Similarly, if the ORF3GC needs to be lowered, corresponding substitutions are made to lower the GC content according to Table 11 and beginning at the 3' end or C-terminal region as described in more detail above. Codons which have a G or C in the third position are used in relative proportions as they occur naturally (as shown in Table 11, Proportional Extreme GC Columns/Highest GC or Lowest GC, as appropriate). In this manner, alterations are made in this section until the desired level of ORF3GC is reached. If the desired level cannot be reached without changing the encoded polypeptide, then changes may be made to bring the GC content as close as possible to the desired level or alternatively amino acid changes can be considered which would allow alteration of the GC content of the nucleotide sequence but which would not significantly affect the function of the encoded polypeptide. One of skill in the art is familiar with the genetic code and would be able to make such sequences and perform functional tests to determine whether function had been so affected by the sequence change as to render the change undesirable.

This process is then applied to the second section of 60 codons in the same manner and then to the remainder of the coding region. Again, if the ORF3GC needs to be lowered, which will often be the case in the remainder of the coding region, it is done so starting from the C-terminus and moving in an N-terminal direction. Once the sequences of these three sections have been altered as described, the sections are combined to create a second template ORF and the ORFGC and ORF3GC of this sequence are determined. Because changes in this example were made to the ORF3GC rather than the ORFGC, the ORFGC may need to be adjusted to the desired level. If the difference between the second template ORFGC and the desired ORFGC is less than 1 nucleotide equivalent, the sequence need not be changed. However, if the difference is more than one nucleotide equivalent, then the number of needed changes is determined according to the following equation:

Percent ORFGC difference=Desired ORFGC−Template ORFGC $$100*N/L = 100*(G+C)_d/L - 100*(G+C)_t/L$$

$$N = (G+C)_d - (G+C)_t$$

A positive number indicates the number of G or C to be added; a negative number indicates the number of G or C to be subtracted. Additional changes are made in the same manner as described above for adjusting the GC content of the entire coding region. In this manner, an altered nucleotide sequence is obtained having the desired GC content and conforming to other known properties of the coding regions of the desired host organism, as particularly exemplified herein for maize. It will be apparent from the methodologies described herein that any host organism could be studied for GC content patterns and a corresponding pattern of substitution designed and implemented for making suitable GC content alterations in a sequence of interest.

Further Adjustments to Sequences

Additional changes may be made to an altered sequence to optimize its expression and conformity to the maize gene structural norm. For example, it may be desirable to make changes to the Kozak context, which is thought to be involved in the optimization of translation efficiency through proper docking of the ribosomal complex. The Kozak context ("ATGGc") occurs around the start codon. Thus, the second amino acid usually begins with a codon that starts with "G", especially "GC", which corresponds to the amino acid alanine. If, on the other hand, the codon following the ATG start codon does not begin with a G, then changing that G generally results in a change in the corresponding amino acid (except for arginine). Such a change may not be desirable if it is important that the sequence continue to encode exactly the same polypeptide sequence, but if this first portion of the protein is a transit peptide or is otherwise cleaved from the final mature protein, such changes may have no effect on the final polypeptide product. Other adjustments can also be made to the coding region, such as the removal of potential RNA processing sites or degradation sequences, removal of premature polyadenylation sequences, and the removal of intron splice or donor sites. Possible intron splice-donor sites may be identified by publicly available computer programs such as GeneSeqer (see Usuka et al. (2000) *Bioinformatics* 16:203–211).

Further changes can be made to add or subtract restriction enzyme sites or, for example, to disrupt regions of strong palindromic tendency which might result in mRNA hairpin loop formation. As one of skill in the art will appreciate, such changes are made with consideration of whether the encoded amino acid is also changed. Where possible, sequence changes that substitute frequently used codons should be chosen over changes that substitute less frequently used codons.

EXAMPLE 17

Optimization of the Mutant Cry8-like K04 Nucleotide Sequence

The original K04 mutant nucleotide sequence (set forth in SEQ ID NO:21) was modified for optimal GC content. This modified sequence is set forth in SEQ ID NO: 63 and encodes the original K04 mutant protein (set forth in SEQ ID NO:22), as demonstrated by the translation of SEQ ID NO:63 set forth in SEQ ID NO:64. Additional changes were then made to improve expression. These changes to improve expression of this sequence included the removal of potential intron splice-donor sites (i.e., GT------AG), the modification of potential premature polyadenylation sites, removal of a potential RNA degradation signal, and modification of restriction sites to facilitate cloning without appreciably altering the codon usage of the reconditioned sequence. These changes are shown in Table 14. The sequence containing these additional changes is known as "1218-1K054B" and is set forth in SEQ ID NO:65 and, as demonstrated by the translation of SEQ ID NO:65 set forth in SEQ ID NO:66, SEQ ID NO:65 encodes the original K04 mutant protein as set forth in SEQ ID NO: 22.

TABLE 14

Changes made to K04 sequence in addition to optimization of GC content.

| Purpose | Position | Change |
|---|---|---|
| Removal of potential intron splice-donor sites | 76, 78 | AGG to CGC, preserving Arg |
| | 1098 | AGG to AGA, preserving Arg |
| | 1500 | GGT to GGC, preserving Gly |
| | 1839 | GGT to GGC, preserving Gly |
| | 1935 | GGT to GGC, preserving Gly |
| Removal of potential polyA sites | 1506 | ACA to ACT, preserving Thr |
| | 1563 | ACA to ACT, preserving Thr |
| | 1926 | CAT to CAC, preserving His |
| Removal of potential RNA degradation signal (ATTTA) | 1566 | ATT to ATC, preserving Ile |
| Modification of restriction sites | 111 | CTG to CTC, preserving Leu and removing a PstI site |
| | 268 | GTG to GTT, preserving Val and removing an ApaI site |
| | 417 | CTG to CTC, preserving Leu and creating an XhoI site |
| | 567 | CCA to CCT, preserving Pro and removing a HindIII site |
| | 615 | GCC to GCT, preserving Ala and removing an NcoI site |
| | 1641 | GGT to GGC, preserving Gly and creating an ApaI site |
| | 1941 | GAT to GAC, preserving Asp and removing a BamHI site |
| Change to preferred codon | 1980 | AGA to AGG, preserving Arg and utilizing the preferred AGG Arg codon |

EXAMPLE 18

Bioassay for Testing The Pesticidal Activity of Mutant Cry8-like K04 Polypeptide Against Western Corn Rootworm and Southern Corn Rootworm A bioassay experiment was conducted to determine the efficacy of Cry8-like mutant K04 polypeptide against western corn rootworm (WCRW) and southern corn rootworm (SCRW) larvae. These bioassays were conducted essentially as set forth in Example 8 except that individual wells were infested with eggs instead of neonates. Approximately 25 eggs were added to each bioassay well with a total of 7 observations at each dose level. The majority of eggs hatched within 24 hours. Percent mortality was scored after 5 days of incubation at 27° C.

The summary of the mortality data shown in Table 15 indicates that the Cry8-like mutant K04 killed over half of the WCRW larvae with moribund (dying or near death) survivors. The results shown in Table 16 reveal that SCRW is much more susceptible to the Cry8-like mutant K04. It was observed that 80% of the SCRW larvae died within 72 hours after feeding on 50 µg/cm² Cry8-like mutant K04 protein (data not shown) and by day 5, all SCRW were dead (see Table 16).

TABLE 15

Bioassay results of WCRW fed K04.

| Sample | Sample Conc. On Diet Surface (µg/cm²) | Mortality (%) |
|---|---|---|
| K04 | 50 | 37/60 = 62* |
| Buffer | | 4/80 = 5 |

*Moribund survivors.

TABLE 16

Bioassay results of SCRW fed K04.

| Sample | Sample Conc. On Diet Surface (µg/cm²) | Mortality (%) |
|---|---|---|
| K04 | 100 | 39/39 = 100 |
| K04 | 50 | 53/53 = 100 |
| Buffer | | 0/41 = 0 |

EXAMPLE 19

In Vivo Study of 1218-1 Protein Degradation by Western Corn Rootworm (WCRW) Gut Proteases An in vivo investigation of the degradation pattern of the 1218-1 truncated protein molecule produced by Western corn rootworm gut proteases was undertaken in order to identify proteolytic sites that may cause degradation and loss of insecticidal activity of the 1218-1 protein molecule. The truncated 1218-1 protein used for this experiment (SEQ ID NO: 12) was generated from a pET-28a expression vector (Novagen, San Diego, Calif.). The expressed protein was His-Tag purified and thrombin treated according to the manufacturer's protocol. A small T7 tag was retained with the 1218-1 protein sample. An additional 19 amino acid residues (1868.01 Da) before the first Methionine of the 1218-1 truncated protein were retained after thrombin treatment.

Protocol

Actively feeding, mid to late 3$^{rd}$ instar WCRW larvae were starved on agar plates overnight. Starved larva were fed with a 0.5 mg/ml 1218-1 protein solution that contained blue food coloring and sucrose, or were fed with solution alone (a control preparation containing sucrose and food coloring). Larvae which imbibed a sufficient quantity of the test or control solution (which stained the food bolus) were allowed to sit at ambient temperatures for 1 hour. After 1 hour, larvae were placed on ice for dissection.

Midguts were carefully removed under cold carbonate buffer fortified with a protease inhibitor cocktail (Complete™ Protease Inhibitor Cocktail fortified with 5 mM EDTA; Roche Diagnostics, Mannheim, Germany). After the fat body and trachea were removed, each midgut was rinsed with several drops of the same buffer. Midguts were then retrieved from the buffer and excess buffer was removed with a paper towel. The middle region of the midgut was then cut with a razor blade and 5 µl buffer was added to the spilled lumenal contents. Therefore, one midgut equivalent was equal to a 5 µl aliquot of the retrieved gut/buffer solution.

Western analysis was performed to identify the 1218-1 sample and its degraded fragments from the gut lumenal contents. WesternBreeze™ Chemiluminescent Immunodetection Kit from Invitrogen (Carlsbad, Calif.) was used according to the manufacturer's protocol for the analysis and visualization of 1218-1 samples.

Results

The majority of the 1218-1 protein fed to Western corn rootworm larvae is processed into a single predominant band of less than 62 kDa, as observed on a 10 minute exposure of the Western blot. Numerous smaller and distinct immunoreactive bands were observed in a 30 minute exposure of the Western blot which were different from the immuno(cross)-reactive protein moieties present in the control preparation. The immunoreactive bands in the control preparation were used to discriminate the background from the true 1218-1 degraded protein fragments shown on the blot. These results indicate that in the Western corn rootworm, the 1218-1 protein is first processed into a protein of approximately 62 kDa, and then is further degraded by gut proteases into small protein fragments. The Western analysis following the in vivo digestion of the 1218-1 protein allowed for the identification of proteolytic sites and provided for a modification of these sites in order to produce a more efficacious insecticidal protein.

EXAMPLE 20

SDS-Page Analysis of the Protease Degradation
1  2  3  4  5  6  7  8
of 1218-1 Protein An in vitro investigation of the degradation pattern of the 1218-1 truncated protein molecule by proteolytic enzymes was undertaken in order to identify proteolytic sites in the molecule that may be available for modification. The truncated 1218-1 protein used for this experiment (SEQ ID NO: 12) was generated from a pET-28a expression vector (Novagen, San Diego, Calif.). The expressed protein was His-Tag purified according to the manufacturer's protocol. Both the His-Tag and a small T7 tag were retained with the 1218-1 protein sample.

Western analysis was performed according to the manufacturer's protocol (Western Breeze™ Chemiluminescent Immunodetection Kit; Invitrogen, Carlsbad, Calif.) in order to identify the 1218-1 protein sample and the protein fragments resulting from the proteolytic digestion. For each test digest, 3 µg of 1218-1 protein and 0.03 µg of enzyme were used. The following enzymes were utilized for this analysis: chymotrypsin, trypsin and papain. The digested 1218-1 samples, as well as an undigested 1218-1 sample, were run out on a gel and blotted.

Results

Micrographs were developed and protein bands were removed from the gel and submitted for N-terminal sequencing. The sequencing results revealed cleavage sites generated from the proteolytic digestion. Residue positions indicated below are relative to the first Methionine of the 1218-1 protein sample, not the Methionine of the His-Tag.

N-terminus sequencing of the approximately 70 kDa band in the chymotrypsin treated sample indicated cleavage of the 1218-1 protein at the carboxyl side of Methionine at position 48. Thus chymotrypsin removed the first 48 amino acid residues at the N-terminus of the 1218-1 protein.

N-terminus sequencing of the approximately 57 kDa band in the trypsin treated sample indicated cleavage of the 1218-1 sample at the carboxyl side of Arginine at position 164. In addition, N-terminus sequencing of the approximately 70 kDa band indicated that the 1218-1 protein sample was cleaved by trypsin at the carboxyl side of Lysine at position 47.

At least 9 major bands were observed from the papain digest of the 1218-1 protein sample. When these digested fragments were isolated and sent for N-terminus sequencing, results from the sequence analysis indicated that 7 of these major bands all contained the same N-terminal sequence at position 49. Thus, these results indicate that there were multiple cleavages of the 1218-1 protein molecule by papain and that these proteolytic sites occur in the C-terminus of the molecule.

EXAMPLE 21

Mutation of Proteolytic Sites in a Modified Pentin-1 Protein

Proteolytic Digestion of a Modified Pentin-1 Protein

Pentin-1 protein was modified by the removal of the putative signal sequence and the addition at the N-terminus of the 4 following amino acids; MADV (SEQ ID NO: 124) (see U.S. Pat. Nos. 6,057,491 and 6,339,144, herein incorporated by reference). These 4 amino acids were added in order to enhance the production of the modified pentin-1 protein in a host cell.

Modified pentin-1 protein (Mod P-1) was produced using the pET30 protein expression system following the manufacturer's protocol (Novagen, Madison, Wis.). The purified, modified pentin-1 protein, at a concentration of 1 mg/ml, was subjected to proteolysis by trypsin, chymotrypsin and papain (digestions occurring at 1/50 w/w). After electrophoresis and blotting of the digested protein samples, select digestion fragments of modified pentin-1 were cut from the trypsin, chymotrypsin, and papain lanes on the blot and sent for N-terminal sequencing. Results from the sequencing indicated that trypsin, chymotrypsin, and papain all cleaved the modified pentin- 1 protein at the N-terminus. Those cleavage sites are designated by capital letters in the following set of contiguous amino acids from the N-terminus of the modified pentin-1 protein: madvaFstQaKaskd (SEQ ID NO: 125). More specifically, chymotrypsin cleaved after 6-F, papain cleaved after 9-Q, and trypsin cleaved after 11-K.

Site-directed Mutagenesis of Modified Pentin-1

Mutagenesis of the modified pentin-1 sequence to remove proteolytic cleavage sites was initiated in an effort to increase pentin-1 toxicity against the Western corn rootworm, WCRW. Due to the close proximity of the three N-terminal cleavage sites associated with trypsin, chymotrypsin, and papain, all three N-terminal cleavage sites were mutated simultaneously. Mutations were introduced using the GeneTailor™ Site-Directed Mutagenesis System following the manufacturer's protocol (Invitrogen, Carlsbad, Calif.). The first 30 amino acids of the modified pentin-1 protein (Mod P-1) as well as the first 30 amino acids of the modified pentin-1 mutant sequences named NEZ1, NEZ2, and NEZ3 are shown in the alignment below. Those amino acids that were changed in the mutants are shown in bold.

```
ModP-1:
MADVAFSTQAKASKDGNLVTVLAIDGGGIR     (SEQ ID NO: 126)

NEZ 1:
MADVAGSTGAGASKDGNLVTVLAIDGGGIR     (SEQ ID NO: 127)

NEZ 2:
MADVAGSTGAHASKDGNLVTVLAIDGGGIR     (SEQ ID NO: 128)

NEZ 3:
MADVAGSTHAHASKDGNLVTVLAIDGGGIR     (SEQ ID NO: 129)
```

Primers used to Create the Mutant Sequences NEZ1, NEZ2 and NEZ3:

The reverse primer (SEQ ID NO: 130):

```
GCCACATCAGCCATGGCCTTGTCGTCGTCG
```

The mutation forward primer for mutant NEZ1 (SEQ ID NO: 131):

```
GACAAGGCCatggctgatgtggcaggctccacaggtgcgggagcttctaaagatggaaac
```

The mutation forward primer for mutant NEZ2 (SEQ ID NO: 132):

```
GACAAGGCCatggctgatgtggcaggctccacaggtgcgcatgcttctaaagatggaaac
```

The mutation forward primer for mutant NEZ3 (SEQ ID NO: 133):

```
GACAAGGCCatggctgatgtggcaggctccacacacgcgcatgcttctaaagatggaaac
```

The following sequence represents the 5' end of the modified pentin-1 expression sequence as it exists in the bacterial host cell and indicates the start of the modified pentin-1 coding sequence (coding region in small letters):

```
CGACGACGACAAGGCCatggctgatgtggc.  (SEQ ID NO: 134)
```

Expression and Digestion of Mutants

After the mutations were confirmed by DNA sequencing, the mutant genes were placed into pET30 vectors and expressed, and the corresponding mutant proteins were purified. The NEZ3 mutant protein was subsequently subjected to proteolytic digestion using the enzymes chymotrypsin, trypsin, and papain and utilizing the protocol described above. This mutant protein was not digested by any of the enzymes used.

Insect Bioassay

Modified pentin-1 protein and the modified pentin-1 mutants, NEZ1 and NEZ3, were used in WCRW insect bioassays essentially as described in Example 1. More specifically, 3 neonate larvae were placed into each well (20 wells per sample), each sample contained protein at a concentration of 1 mg/ml, the test sample volume topically applied to each well was 50 µl, and larval mortality was scored at 5 days post infestation.

The results shown below in Table 17 for a first experiment indicate that the pentin-1 mutant named NEZ3 inhibits the growth of WCRW larvae more than the modified pentin-1 protein (Mod P-1). The results shown below in Table 18 for a second experiment indicate that the modified pentin-1 mutants NEZ1 and NEZ3 inhibit the growth of WCRW larvae more than modified pentin-1 (Mod P-1).

TABLE 17

WCRW Bioassay of Modified Pentin-1 (Mod P-1) and its Mutant NEZ3

| Sample | Mortality (%) | Comment |
|---|---|---|
| Replicate 1: | | |
| NEZ3 | 29/59 = 49% | Moderate–severe stunting |
| Mod P-1 | 26/60 = 43% | Moderate stunting |

TABLE 17-continued

WCRW Bioassay of Modified Pentin-1 (Mod P-1) and its Mutant NEZ3

| Sample | Mortality (%) | Comment |
|---|---|---|
| Replicate 2: | | |
| NEZ3 | 34/54 = 62% | Moderate–severe stunting |
| Mod P-1 | 33/51 = 65% | Moderate stunting |

TABLE 18

WCRW Bioassay of Modified Pentin-1 (Mod P-1) and its Mutants NEZ1 and NEZ3

| Sample | Concentration | Average Larval Weight (µg) |
|---|---|---|
| Mod P-1 | 1 µg/µl | 154 |
| Mod P-1 | 0.67 µg/µl | 115 |
| Mod P-1 | 0.33 µg/µl | 137 |
| NEZ1 | 1 µg/µl | 109 |
| NEZ1 | 0.67 µg/µl | 116 |
| NEZ1 | 0.33 µg/µl | 121 |
| NEZ3 | 1 µg/µl | 130 |
| NEZ3 | 0.67 µg/µl | 122 |
| NEZ3 | 0.33 µg/µl | 110 |
| Buffer | 19 | 395 |
| Diet | 18 | 347 |

All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the embodiments.

SEQUENCE LISTING (134 sequences)

SEQ ID NO: 1 - DNA, 3621 bp, Bacillus thuringiensis
  CDS (1)...(3621)
  misc_feature (0)...(0): Cry1218-1
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccaaatggttcaagagccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacattaaatttagcaacagatagttcgctagcattgaaacataatttaggtgaagaccctaattcaacattatctggtatagtttacgttgaccgaatcgaattcatcccagtagatgagacatatgaagcggaacaagatttagaagcagcgaagaaagcagtgaatgccttgtttacgaatacaaaagatggcttacgaccaggcgtaacggattatgaagtgaatcaagcggcaaacttagtggaatgcctatcggatgatttgtatccaaatgaaaaacgattgttatttgatgcagtgagagaggcaaaacgcctcagtgaggcacgtaatttgcttcaagatccagatttccaagagataaatggagaaaatggctggacggcaagtacgggaattgaggttatagaaggggatgctttattcaaagggcgttatctacgcctaccaggtgcgagagaaatagatacggaaacgtatccaacgtatctgtatcaaaaagtagaggaaggtgtattaaaaccatacacaagatatagattgagagggtttgtcggaagcagtcaaggattggaaattttcacaattcgtcatcaaacgaaccgaattgtaaaaaatgtaccggatgatttgctgccagatgtatctcctgttaactcggatggtagtatcaatcgatgcagcgaacaaaagtatgtgaatagccgtttagaagtagaaaaccgttctggtgaagcgcatgagttctctattcctattgatacaggtgaaatcgattacaatgaaaatgcaggaatatgggttggatttaagattacggacccagagggatatgcaacactcggaaacctagaattggtcgaagagggacctttatcaggagacgcattagaacgcttgcaaagagaagaacaacagtggaagattcaaatgacaagaagacgtgaagaaacagatagaaggtatatggcatcgaaacaagcggtagatcgtttatatgccgattatcaggatcagcaactgaatcctgatgtagagattacagatcttactgcggcccaagatctgatacagtccattccttacgtatataacgaaatgttcccagaaataccagggatgaactatacgaagtttacagaattaacagatcgactccaacaagcgtggagtttgtatgatcagcgaaatgccataccaaatggtgattttcgaaatgggttaagtaattggaatgcaacgcctggcgtagaagtacaacaaatcaatcatacatctgtccttgtgattccaaactgggatgagcaagtttcgcaacagtttacagttcaaccgaatcaaagatatgtgttacgagttactgcgagaaaagaaggggtaggaaatggatatgtaagtatccgtgatggtggaaatcaaacagaaacgcttacttttagtgcaagcgattatgatacaaatggaatgtataatacgcaagtgtccaatacaaatggatataacacaaataatgcgtataatacacaagcatcgagtacaaacggatataacgcaaataatatgtataatacgcaagcatcgaatacaaacggatataacacaaatagtgtgtacaatgatcaaaccggctatatcacaaaaacagtgacattcatcccgtatacagatcaaatgtggattgagatgagtgagacagaaggtacattctatatagaaagtgtagaattgattgtagacgtagagtaa

SEQ ID NO: 2 - protein, 1206 aa, Bacillus thuringiensis
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTLNLATDSSLALKHNLGEDPNSTLSGIVYVDRIEFIPVDETYEAEQDLEAAKKAVNALFTNTKDGLRPGVTDYEVNQAANLVECLSDDLYPNEKRLLFDAVREAKRLSEARNLLQDPDFQEINGENGWTASTGIEVIEGDALFKGRYLRLPGAREIDTETYPTYLYQKVEEGVLKPYTRYRLRGFVGSSQGLEIFTIRHQTNRIVKNVPDDLLPDVSPVNSDGSINRCSEQKYVNSRLEVENRSGEAHEFSIPIDTGEIDYNENAGIWVGFKITDPEGYATLGNLELVEEGPLSGDALERLQREEQQWKIQMTRRREETDRRYMASKQAVDRLYADYQDQQLNPDVEITDLTAAQDLIQSIPYVYNEMFPEIPGMNYTKFTELTDRLQQAWSLYDQRNAIPNGDFRNGLSNWNATPGVEVQQINHTSVLVIPNWDEQVSQQFTVQPNQRYVLRVTARKEGVGNGYVSIRDGGNQTETLTFSASDYDTNGMYNTQVSNTNGYNTNNAYNTQASSTNGYNANNMYNTQASNTNGYNTNSVYNDQTGYITKTVTFIPYTDQMWIEMSETEGTFYIESVELIVDVE

SEQ ID NO: 3 - DNA, 3633 bp, Bacillus thuringiensis
  CDS (1)...(3633)
  misc_feature (0)...(0): Cry1218-2
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcagggcaaaagagtcaatgggagatttttatggaacaagtagaagaactcataaatcaaaaaatagcagaatatgcaaggaataaagcgctttcggaattagaaggattaggtaataattaccaattatatctaactgcgcttgaagaatggaaagaaaatccaaatggttcaagagccttacgagatgtgcgaaatcgatttgaaatcctggatagtttatttacgcaatacatgccatcttttcgagtgacaaattttgaagtaccattccttacagtatatacacaggcagccaaccttcatttactgttattaaaggacgcttcaatttttggagaagaatggggatggtctacaaccactattaataactattatgatcgtcaaatgaaacttactgcagaatattctgatcactgtgtaaagtggtatgaaactggtttagcaaaattaaaaggcacgagcgctaaacaatgggtcgactataaccaattccgtagagaaatgacactgacggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctatcatcggatttttagtgataatattataaaacagatgtatggaactaatcaaaatctacacagcactagtacctttgattttacgaattatgatatttacaagacgttatcaaaagatgcggtgctccttgatattgtttttcctggttatacgtatatattttttggaatgccagaagtcgagtttttcatggtaaaccaattgaataataccagaaagacgttaaagtataatccggtttccaaagatattatagcggggacaagagattcggaattagaattacctccagaaacttcagatcaaccaaattatgagtcatatagccatagattatgtcatatcacaagtattcccgcgacgggttcaactaccggattagtacctgtattttcttggacacatcggagtgccgatcttataaatgcagttcattcagataaaattactcagattccggtcgtaaaggtttctgatttggctccctctataacaggagggccaaataataccgttgtatcgggtcctggatttacagggggggggataataaaagtaataagaaatggagtaattatatcacatatgcgtgttaaaatttcagacattaacaaagaatatagtatgaggattcggtatgcttccgctaataatactgaattttatataaatccttctgaagaaaacgttaaatctcacgctcaaaaaactatgaatagaggtgaagctttaacatataataaatttaattatgcgactttgccccctattaaatttacgacaaccgaacctttcattactctaggggctatatttgaagcggaagactttcttggaattgaagcttatatagaccgaatcgaatttatcccagtagatgagacatatgaagcggaacaagatttagaagcagcgaagaaagcagtgaatgccttgtttacgaatacaaaagatggcttacgaccaggcgtaacggattatgaagtgaatcaagcggcaaacttagtggaatgcctatcggatgatttgtatccaaatgaaaaacgattgttatttgatgcagtgagagaggcaaaacgcctcagtgaggcacgtaatttgcttcaagatccagatttccaagagataaatggagaaaatggctggacggcaagtacgggaattgaggttatagaaggggatgctttattcaaagggcgttatctacgcctaccaggtgcgagagaaatagatacggaaacgtatccaacgtatctgtatcaaaaagtagaggaaggtgtattaaaaccatacacaagatatagattgagagggtttgtcggaagcagtcaaggattggaaattttcacaattcgtcatcaaacgaaccgaattgtaaaaaatgtaccggatgatttgctgccagatgtatctcctgttaactcggatggtagtatcaatcgatgcagcgaacaaaagtatgtgaatagccgtttagaagtagaaaaccgttctggtgaagcgcatgagttctctattcctattgatacaggtgaaatcgattacaatgaaaatgcaggaatatgggttggatttaagattacggacccagagggatatgcaacactcggaaacctagaattggtcgaagagggacctttatcaggagacgcattagaacgcttgcaaagagaagaacaacagtggaagattcaaatgacaagaagacgtgaagaaacagatagaaggtatatggcatcgaaacaagcggtagatcgtttatatgccgattatcaggatcagcaactgaatcctgatgtagagattacagatcttactgcggcccaagatctgatacagtccattccttacgtatataacgaaatgttcccagaaataccagggatgaactatacgaagtttacagaattaacagatcgactccaacaagcgtggagtttgtatgatcagcgaaatgccataccaaatggtgattttcgaaatgggttaagtaattggaatgcaacgcctggcgtagaagtacaacaaatcaatcatacatctgtccttgtgattccaaactgggatgagcaagtttcgcaacagtttacagttcaaccgaatcaaagatatgtgttacgagttactgcgagaaaagaaggggtaggaaatggatatgtaagtatccgtgatggtggaaatcaaacagaaacgcttacttttagtgcaagcgattatgatacaaatggaatgtataatacgcaagtgtccaatacaaatggatataacacaaataatgcgtataatacacaagcatcgagtacaaacggatataacgcaaataatatgtataatacgcaagcatcgaatacaaacggatataacacaaatagtgtgtacaatgatcaaaccggctatatcacaaaaacagtgacattcatcccgtatacagatcaaatgtggattgagatgagtgagacagaaggtacattctatatagaaagtgtagaattgattgtagacgtagagtaa

SEQ ID NO: 4 - protein, 1210 aa, Bacillus thuringiensis
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGQKSQWEIFMEQVEELINQKIAEYARNKALSELEGLGNNYQLYLTALEEWKENPNGSRALRDVRNRFEILDSLFTQYMPSFRVTNFEVPFLTVYTQAANLHLLLLKDASIFGEEWGWSTTTINNYYDRQMKLTAEYSDHCVKWYETGLAKLKGTSAKQWVDYNQFRREMTLTVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRIFSDNIIKQMYGTNQNLHSTSTFDFTNYDIYKTLSKDAVLLDIVFPGYTYIFFGMPEVEFFMVNQLNNTRKTLKYNPVSKDIIAGTRDSELELPPETSDQPNYESYSHRLCHITSIPATGSTTGLVPVFSWTHRSADLINAVHSDKITQIPVVKVSDLAPSITGGPNNTVVSGPGFTGGGIIKVIRNGVIISHMRVKISDINKEYSMRIRYASANNTEFYINPSEENVKSHAQKTMNRGEALTYNKFNYATLPPIKFTTTEPFITLGAIFEAEDFLGIEAYIDRIEFIPVDETYEAEQDLEAAKKAVNALFTNTKDGLRPGVTDYEVNQAANLVECLSDDLYPNEKRLLFDAVREAKRLSEARNLLQDPDFQEINGENGWTASTGIEVIEGDALFKGRYLRLPGAREIDTETYPTYLYQKVEEGVLKPYTRYRLRGFVGSSQGLEIFTIRHQTNRIVKNVPDDLLPDVSPVNSDGSINRCSEQKYVNSRLEVENRSGEAHEFSIPIDTGEIDYNENAGIWVGFKITDPEGYATLGNLELVEEGPLSGDALERLQREEQQWKIQMTRRREETDRRYMASKQAVDRLYADYQDQQLNPDVEITDLTAAQDLIQSIPYVYNEMFPEIPGMNYTKFTELTDRLQQAWSLYDQRNAIPNGDFRNGLSNWNATPGVEVQQINHTSVLVIPNWDEQVSQQFTVQPNQRYVLRVTARKEGVGNGYVSIRDGGNQTETLTFSASDYDTNGMYNTQVSNTNGYNTNNAYNTQASSTNGYNANNMYNTQASNTNGYNTNSVYNDQTGYITKTVTFIPYTDQMWIEMSETEGTFYIESVELIVDVE

SEQ ID NO: 5 - DNA, 2010 bp, Artificial Sequence
  CDS (1)...(2010): Maize optimized Cry1218-1
  misc_feature (0)...(0): mo1218-1
atgtcccccaacaaccagaacgagtacgagatcatcgacgccaccccctccacctccgtgtccaacgactccaaccgctaccccttcgccaacgagcccaccaacgccctccagaacatggactacaaggactacctcaagatgtccgccggcaacgcctccgagtaccccggctcccccgaggtgctcgtgtccggccaggacgccgccaaggccgccatcgacatcgtgggcaagctcctctccggcctcggcgtgcccttcgtgggccccatcgtgtccctctacacccagctcatcgacatcctctggccctccggcgagaagtcccagtgggaaatcttcatggagcaggtggaggagctcatcaaccagaagatcgccgagtacgcccgcaacaaggccctctccgagctggagggcctcggcaacaactaccagctctacctcaccgccctggaggagtgggaggagaaccccaacggctcccgcgccctccgcgacgtgcgcaaccgcttcgagatcctcgactccctcttcacccagtacatgccctccttccgcgtgaccaacttcgaggtgcccttcctcaccgtgtacgccatggccgccaacctccacctcctcctcctcaaggacgcctccatcttcggcgaggagtggggctggtccaccaccaccatcaacaactactacgaccgccagatgaagctcaccgccgagtactccgaccactgcgtgaagtggtatgagaccggcctcgccaagctcaagggcacctccgccaagcagtgggtggactacaaccagttccgccgcgagatgaccctcgccgtgctcgacgtggtggccctcttccccaactacgacacccgcacctaccccatggagaccaaggcccagctcacccgcgaggtgtacaccgacccgctcggcgccgtgaacgtgtcctccatcggctcttggtacgacaaggccccaagcttcggcgtgatcgagtcctccgtgatccgcccgccgcacgtgttcgactacatcaccggcctcaccgtgtacacccagtcccgctccatctcctccgcccgctacatccgccactgggccggccaccagatctcctaccaccgcgtgtcccgcggctccaacctccagcagatgtacggcaccaaccagaacctccactccacctccaccttcgacttcaccaactacgacatctacaagaccctctccaaggacgccgtgctcctcgacatcgtgtaccccggctacacctacatcttcttcggcatgccggaggtggagttcttcatggtgaaccagctcaacaacacccgcaagaccctcaaatacaaccccgtgtccaaggacatcatcgcctccacccgcgactccgagctcgagctcccccccgagacctccgaccagcccaactacgagtcctactcccaccgcctctgccacatcacctccatccccgccaccggcaacaccaccggcctcgtgccggtgttctcctggacccaccgctctgcagacctcaacaacaccatctactccgacaagatcacccagatccccgccgtgaagtgctgggacaacctccccttcgtgcccgtggtgaagggccccggccacaccggcggcgacctcctccagtacaaccgctccaccggctccgtgggcaccctcttcctcgcccgctacggcctcgccctggagaaggccggcaagtaccgcgtgcgcctccgctacgccactgacgccgacatcgtgctccacgtgaacgacgcccagatccagatgcccaagaccatgaaccccggcgaggacctcacctccaagaccttcaaggtggccgacgccatcaccaccctcaacctcgccaccgactcctccctcgccctcaagcacaacctcggcgaggaccccaactccaccctctccggcatcgtgtacgtggaccgcatcgagttcatccccgtggacgagacctacgaggccgagtga

SEQ ID NO: 6 - protein, 669 aa, Artificial Sequence
  Maize optimized Cry1218-1
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTLNLATDSSLALKHNLGEDPNSTLSGIVYVDRIEFIPVDETYEAE

SEQ ID NO: 7 - DNA, 2022 bp, Bacillus thuringiensis (mutated)
  CDS (1)...(2022)
  misc_feature (0)...(0): NGSR.N1218-1
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccaaatggttcaagaaatggttcccgggccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacattaaatttagcaacagatagttcgctagcattgaaacataatttaggtgaagaccctaattcaacattatctggtatagtttacgttgaccgaatcgaattcatcccagtagatgagacatatgaagcggaataa

SEQ ID NO: 8 - protein, 673 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRNGSRALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTLNLATDSSLALKHNLGEDPNSTLSGIVYVDRIEFIPVDETYEAE

SEQ ID NO: 9 - DNA, 12 bp, Artificial Sequence
  NGSR Insert
aatggttcccgg

SEQ ID NO: 10 - protein, 4 aa, Artificial Sequence
  NGSR Insert
NGSR

SEQ ID NO: 11 - DNA, 2010 bp, Bacillus thuringiensis (truncated)
  CDS (1)...(2010)
  misc_feature (0)...(0): 1218-1A
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccaaatggttcaagagccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacattaaatttagcaacagatagttcgctagcattgaaacataatttaggtgaagaccctaattcaacattatctggtatagtttacgttgaccgaatcgaattcatcccagtagatgagacatatgaagcggaataa

SEQ ID NO: 12 - protein, 669 aa, Bacillus thuringiensis (truncated); identical to SEQ ID NO: 6

SEQ ID NO: 13 - DNA, 2022 bp, Bacillus thuringiensis (truncated)
  CDS (1)...(2022)
  misc_feature (0)...(0): 1218-2A
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcagggcaaaagagtcaatgggagatttttatggaacaagtagaagaactcataaatcaaaaaatagcagaatatgcaaggaataaagcgctttcggaattagaaggattaggtaataattaccaattatatctaactgcgcttgaagaatggaaagaaaatccaaatggttcaagagccttacgagatgtgcgaaatcgatttgaaatcctggatagtttatttacgcaatacatgccatcttttcgagtgacaaattttgaagtaccattccttacagtatatacacaggcagccaaccttcatttactgttattaaaggacgcttcaatttttggagaagaatggggatggtctacaaccactattaataactattatgatcgtcaaatgaaacttactgcagaatattctgatcactgtgtaaagtggtatgaaactggtttagcaaaattaaaaggcacgagcgctaaacaatgggtcgactataaccaattccgtagagaaatgacactgacggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctatcatcggatttttagtgataatattataaaacagatgtatggaactaatcaaaatctacacagcactagtacctttgattttacgaattatgatatttacaagacgttatcaaaagatgcggtgctccttgatattgtttttcctggttatacgtatatattttttggaatgccagaagtcgagtttttcatggtaaaccaattgaataataccagaaagacgttaaagtataatccggtttccaaagatattatagcggggacaagagattcggaattagaattacctccagaaacttcagatcaaccaaattatgagtcatatagccatagattatgtcatatcacaagtattcccgcgacgggttcaactaccggattagtacctgtattttcttggacacatcggagtgccgatcttataaatgcagttcattcagataaaattactcagattccggtcgtaaaggtttctgatttggctccctctataacaggagggccaaataataccgttgtatcgggtcctggatttacagggggggggataataaaagtaataagaaatggagtaattatatcacatatgcgtgttaaaatttcagacattaacaaagaatatagtatgaggattcggtatgcttccgctaataatactgaattttatataaatccttctgaagaaaacgttaaatctcacgctcaaaaaactatgaatagaggtgaagctttaacatataataaatttaattatgcgactttgccccctattaaatttacgacaaccgaacctttcattactctaggggctatatttgaagcggaagactttcttggaattgaagcttatatagaccgaatcgaatttatcccagtagatgagacatatgaagcggaataa

SEQ ID NO: 14 - protein, 673 aa, Bacillus thuringiensis (truncated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGQKSQWEIFMEQVEELINQKIAEYARNKALSELEGLGNNYQLYLTALEEWKENPNGSRALRDVRNRFEILDSLFTQYMPSFRVTNFEVPFLTVYTQAANLHLLLLKDASIFGEEWGWSTTTINNYYDRQMKLTAEYSDHCVKWYETGLAKLKGTSAKQWVDYNQFRREMTLTVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRIFSDNIIKQMYGTNQNLHSTSTFDFTNYDIYKTLSKDAVLLDIVFPGYTYIFFGMPEVEFFMVNQLNNTRKTLKYNPVSKDIIAGTRDSELELPPETSDQPNYESYSHRLCHITSIPATGSTTGLVPVFSWTHRSADLINAVHSDKITQIPVVKVSDLAPSITGGPNNTVVSGPGFTGGGIIKVIRNGVIISHMRVKISDINKEYSMRIRYASANNTEFYINPSEENVKSHAQKTMNRGEALTYNKFNYATLPPIKFTTTEPFITLGAIFEAEDFLGIEAYIDRIEFIPVDETYEAE

SEQ ID NO: 15 - DNA, 1860 bp, Bacillus thuringiensis (truncated)
  CDS (10)...(1860)
  misc_feature (0)...(0): 49PVD
tccatgggcatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccaaatggttcaagagccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacattaaatttagcaacagatagttcgctagcattgaaacataatttaggtgaagaccctaattcaacattatctggtatagtttacgttgaccgaatcgaattcatcccagtagattaa

SEQ ID NO: 16 - protein, 616 aa, Bacillus thuringiensis (truncated)
MSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTLNLATDSSLALKHNLGEDPNSTLSGIVYVDRIEFIPVD

SEQ ID NO: 17 - DNA, 4874 bp, Bacillus thuringiensis
  misc_feature (0)...(0): Genomic DNA 1218-1
ggtttccattcccaccggttttcactttcaaaaaccccaatacaccgaaacttgtctatgatgtgagtcatttatcttatggcaaaagagatgtgtaaacgaacgattgacgtagaggattgtgggcaaattgagatagatttacatgtcttaaaaattaaaggtgttttaccgtttatcgtgaacgtatccattgaaccgcttagtatggaacatgtatataccacaagtggtagagacacatccttatttttaagttgtcaagaaacggtatatgtggatcatattttaaaatatagtgttgatcatgtcccatattatgtaattgatggccatcatattcaagtgcgtgatgtatcgattaaattgatggaagaaaacccacaaactgctcaaatatcgggtgttttttattttgattatgcataattataaaaaatcaaaaaatattttgtgaagaatccctaaaattatcacaacattgtttattataaaataactcatttcaagaaaaatcgtaatatttttttatctaacaggaattttatcatctacagaagaatattcttatcatggtaatgaggagggagagtgacagagaggggatagacaatcaaaagagtatctagaagagtttgtcatgtaagaacaaaaggaatctatcgtatatgctactcaaaagaaagtgtaaaaaatctttgtatcttgtatatgtataggaggaaaatagatgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccaaatggttcaagagccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacattaaatttagcaacagatagttcgctagcattgaaacataatttaggtgaagaccctaattcaacattatctggtatagtttacgttgaccgaatcgaattcatcccagtagatgagacatatgaagcggaacaagatttagaagcagcgaagaaagcagtgaatgccttgtttacgaatacaaaagatggcttacgaccaggcgtaacggattatgaagtgaatcaagcggcaaacttagtggaatgcctatcggatgatttgtatccaaatgaaaaacgattgttatttgatgcagtgagagaggcaaaacgcctcagtgaggcacgtaatttgcttcaagatccagatttccaagagataaatggagaaaatggctggacggcaagtacgggaattgaggttatagaaggggatgctttattcaaagggcgttatctacgcctaccaggtgcgagagaaatagatacggaaacgtatccaacgtatctgtatcaaaaagtagaggaaggtgtattaaaaccatacacaagatatagattgagagggtttgtcggaagcagtcaaggattggaaattttcacaattcgtcatcaaacgaaccgaattgtaaaaaatgtaccggatgatttgctgccagatgtatctcctgttaactcggatggtagtatcaatcgatgcagcgaacaaaagtatgtgaatagccgtttagaagtagaaaaccgttctggtgaagcgcatgagttctctattcctattgatacaggtgaaatcgattacaatgaaaatgcaggaatatgggttggatttaagattacggacccagagggatatgcaacactcggaaacctagaattggtcgaagagggacctttatcaggagacgcattagaacgcttgcaaagagaagaacaacagtggaagattcaaatgacaagaagacgtgaagaaacagatagaaggtatatggcatcgaaacaagcggtagatcgtttatatgccgattatcaggatcagcaactgaatcctgatgtagagattacagatcttactgcggcccaagatctgatacagtccattccttacgtatataacgaaatgttcccagaaataccagggatgaactatacgaagtttacagaattaacagatcgactccaacaagcgtggagtttgtatgatcagcgaaatgccataccaaatggtgattttcgaaatgggttaagtaattggaatgcaacgcctggcgtagaagtacaacaaatcaatcatacatctgtccttgtgattccaaactgggatgagcaagtttcgcaacagtttacagttcaaccgaatcaaagatatgtgttacgagttactgcgagaaaagaaggggtaggaaatggatatgtaagtatccgtgatggtggaaatcaaacagaaacgcttacttttagtgcaagcgattatgatacaaatggaatgtataatacgcaagtgtccaatacaaatggatataacacaaataatgcgtataatacacaagcatcgagtacaaacggatataacgcaaataatatgtataatacgcaagcatcgaatacaaacggatataacacaaatagtgtgtacaatgatcaaaccggctatatcacaaaaacagtgacattcatcccgtatacagatcaaatgtggattgagatgagtgagacagaaggtacattctatatagaaagtgtagaattgattgtagacgtagagtaatagtagtacccctccagatgaaacctgtatctggaggggttttttatgcaaaagagtcttttcatacagaatatattggttttacccggattacatattttgtgaataggactatggttggttaccttacggtacctttttatatccaccggcattggaaaatgtaagagggaggataatcatatatagtcccttccctacacatcaaattccttcgaaagtttctcgtgaatgagagtgaatatttctttttgtactttattcaggtcttgtaagaaaggaatggtattcacacaaatgatgggtgtggatacgtctgttaaacctgagatatttgtaataatcaagtcatagttttttgcaatctgtttaaatgagctgagatgtaatacatcaatcttagatagttgaatcatatgaccaaattgatactgcataatattacgaataaatagggtatgttccatatctgaatcacaaaaaatgccgacatgaagaacaggaaccttctgttttaaagctt

SEQ ID NO: 18 - DNA, 6613 bp, Bacillus thuringiensis
  misc_feature (0)...(0): Genomic Cry1218-2
ttttaggtattcttttaagttctttatagagacagattaacgaaaaactaaataagaaattcaatcccttgatacatgatgcatcggatgccaaattattagtacgtatcttgcgtatattgtacgaggtcgaattgacgtaacagggcacctttttggtcaaattgaccaaagaatccatcctttgcatgagcacttctcgaaaccacttcccatagtgcacttcttatcttttgtatatatttcctaaggatatcgtaatccctatttctgataagaggattttgtcagtgtaggaagagcgaatgtcttttcgtatttcaaacaaaaaataaaggatgtttatgcacggaaataatcatcatattaataatgcccagtacataaagatagatgggggtcattttttgaaatgattcgaaaagactccgttgactcgataggaggtgcacagaaaaatggaagaaagatatgcatcgcaagatcagtcggatgtagaagtttctaatcgcaaggggaagaaaaaccatacagttccctttcaatgtatggtttccattccaacaggttttcaaattcaaaaacccaatacaccgaaacttgtctatgatgtgagtcatttatctatggcaaaagagatgtgtaaacgaacgattgacgtagaggattgtgggcaaattgagatagatttacatgtcttaaaaattaaaggtgttttaccgtttatcgtgaacgtatccattgaaccgcttagtatgaacatgtatataccacaagtggtagagacacatccttatttttaagttgtcaagaaacggtatatgtggatcatattttaaaatatagtgttgatcatgtcccgtattatgtaattgatggccatcatattcaagtgcgtgatgtatcgattaaattgatggaagaaaacccacaaactgctcaaatatcgggtgttttttattttgattatgcataattttaaaaaatcaaaaaatattttgtgaagaatccctaaaattatcacaacattgtttattataaaataactcatttcaagaaaaatcgtaatatttttttatctaacaggaattttatcatctacagaagaatattcttatcatggtaatgaggagggagagtgacagtcaaaagagtacctggtttgtcgtgtaagaaaaaagaatcgatcgtacaggaaagttaaaaaaagtgtaagaaattttatatcttttgtatgtataggaggaaaatagatgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcagggcaaaagagtcaatgggagatttttatggaacaagtagaagaactcataaatcaaaaaatagcagaatatgcaaggaataaagcgctttcggaattagaaggattaggtaataattaccaattatatctaactgcgcttgaagaatggaaagaaaatccaaatggttcaagagccttacgagatgtgcgaaatcgatttgaaatcctggatagtttatttacgcaatacatgccatcttttcgagtgacaaattttgaagtaccattccttacagtatatacacaggcagccaaccttcatttactgttattaaaggacgcttcaatttttggagaagaatggggatggtctacaaccactattaataactattatgatcgtcaaatgaaacttactgcagaatattctgatcactgtgtaaagtggtatgaaactggtttagcaaaattaaaaggcacgagcgctaaacaatgggtcgactataaccaattccgtagagaaatgacactgacggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctatcatcggatttttagtgataatattataaaacagatgtatggaactaatcaaaatctacacagcactagtacctttgattttacgaattatgatatttacaagacgttatcaaaagatgcggtgctccttgatattgtttttcctggttatacgtatatattttttggaatgccagaagtcgagtttttcatggtaaaccaattgaataataccagaaagacgttaaagtataatccggtttccaaagatattatagcggggacaagagattcggaattagaattacctccagaaacttcagatcaaccaaattatgagtcatatagccatagattatgtcatatcacaagtattcccgcgacgggttcaactaccggattagtacctgtattttcttggacacatcggagtgccgatcttataaatgcagttcattcagataaaattactcagattccggtcgtaaaggtttctgatttggctccctctataacaggagggccaaataataccgttgtatcgggtcctggatttacagggggggggataataaaagtaataagaaatggagtaattatatcacatatgcgtgttaaaatttcagacattaacaaagaatatagtatgaggattcggtatgcttccgctaataatactgaattttatataaatccttctgaagaaaacgttaaatctcacgctcaaaaaactatgaatagaggtgaagctttaacatataataaatttaattatgcgactttgccccctattaaatttacgacaaccgaacctttcattactctaggggctatatttgaagcggaagactttcttggaattgaagcttatatagaccgaatcgaatttatcccagtagatgagacatatgaagcggaacaagatttagaagcagcgaagaaagcagtgaatgccttgtttacgaatacaaaagatggcttacgaccaggcgtaacggattatgaagtgaatcaagcggcaaacttagtggaatgcctatcggatgatttgtatccaaatgaaaaacgattgttatttgatgcagtgagagaggcaaaacgcctcagtgaggcacgtaatttgcttcaagatccagatttccaagagataaatggagaaaatggctggacggcaagtacgggaattgaggttatagaaggggatgctttattcaaagggcgttatctacgcctaccaggtgcgagagaaatagatacggaaacgtatccaacgtatctgtatcaaaaagtagaggaaggtgtattaaaaccatacacaagatatagattgagagggtttgtcggaagcagtcaaggattggaaattttcacaattcgtcatcaaacgaaccgaattgtaaaaaatgtaccggatgatttgctgccagatgtatctcctgttaactcggatggtagtatcaatcgatgcagcgaacaaaagtatgtgaatagccgtttagaagtagaaaaccgttctggtgaagcgcatgagttctctattcctattgatacaggtgaaatcgattacaatgaaaatgcaggaatatgggttggatttaagattacggacccagagggatatgcaacactcggaaacctagaattggtcgaagagggacctttatcaggagacgcattagaacgcttgcaaagagaagaacaacagtggaagattcaaatgacaagaagacgtgaagaaacagatagaaggtatatggcatcgaaacaagcggtagatcgtttatatgccgattatcaggatcagcaactgaatcctgatgtagagattacagatcttactgcggcccaagatctgatacagtccattccttacgtatataacgaaatgttcccagaaataccagggatgaactatacgaagtttacagaattaacagatcgactccaacaagcgtggagtttgtatgatcagcgaaatgccataccaaatggtgattttcgaaatgggttaagtaattggaatgcaacgcctggcgtagaagtacaacaaatcaatcatacatctgtccttgtgattccaaactgggatgagcaagtttcgcaacagtttacagttcaaccgaatcaaagatatgtgttacgagttactgcgagaaaagaaggggtaggaaatggatatgtaagtatccgtgatggtggaaatcaaacagaaacgcttacttttagtgcaagcgattatgatacaaatggaatgtataatacgcaagtgtccaatacaaatggatataacacaaataatgcgtataatacacaagcatcgagtacaaacggatataacgcaaataatatgtataatacgcaagcatcgaatacaaacggatataacacaaatagtgtgtacaatgatcaaaccggctatatcacaaaaacagtgacattcatcccgtatacagatcaaatgtggattgagatgagtgagacagaaggtacattctatatagaaagtgtagaattgattgtagacgtagagtaatagtagtacccctccagatgaaacctgtatctggaggggttttttatgcaaaagagtcttttcatacagaatatattggttttacccggattacatattttgtgaataggactatggttggttaccttacggtacctttttatatccaccggcattggaaaatgtaagagggaggataatcatatatagtcccttccctacacatcaaattccttcgaaagtttctcgtgaatgagagtgaatatttctttttgtactttattcaggtcttgtaagaaaggaatggtattcacacaaatgatgggtgtggatacgtctgttaaacctgagatatttgtaataatcaagtcatagttttttgcaatctgtttaaatgagctgagatgtaatacatcaatcttagatagttgaatcatatgaccaaattgatactgcataatattacgaataaatagggtatgttccatatctgaatcacaaaaaatgccgacatgaagaacaggaaccttctgttttaaagcttgtaataagtttgtccaatgtatgattaaaatatataatgtttccgtaaaaacatgctcgtcccatttgaactgttcatgatagtgaaagtgagttaattcttcttttaaaagcaagacaaagtatgaaaattcgtgagaatgatgctcggaaaaaaaacgtcttttatcatgtaaaataaaactacgtccataattcatggtttgtaaattgtataactccaaaatgattttttgtttattttggagaggcacatgtagtttgtcggatagtctatgcaataagtttagaatttcaggaacaattttccatgcgtcatttgatttttgttgtaccatagtttctaattgctcatacgtaaatgcataatgatgattaaaaaaaacagagaagagttggtaaacagtctcatgattaaaatcaagagaaaaggtatcccggaacaattgacaaaatgagctgttctcaaaaatacttacatccaaaggattggaaaaatcttctgaaatggttttcatatgctggtgttgtaaacgaatcacattcaccattgtccaataccgaatccgtatgaggtctggaaaatttagttgtatctgatttttttgggtgacatatagaaagagttgatccaatgcctgtagttggttgtctgggaaaggagtatgagtcacaccatatttttcataaaaaaactggaccataatacttctaatatgttgttcatttcctatgattttacaaggatttgtttgaatgtgtatctcatattgttcgagatacacattcaattttgtgataatccgccttagggtggaagtactaagaaataattcctccgcgattgtctctatgtcatctctttcatcaaaaaatatccgttcgataaaggaaaactcaggacttacagataagaccttttgatatataaaatcaatagaatactgagaaggataggttaacataatcccttttatagatgtctcaatctgaaaaggttgaaattcttgattaataaatttaatgtcatctctcaaaattctttcggaacaatttagtgtttgtgcactcactcctaacgtatgccatccatcttgttcatatagtagttctaagaattgtagttgtctgcgtaaattgttatttaaaagagaacgcatgagtagacaccttctttcatttataaaatatcactgatggaattc

SEQ ID NO: 19 - DNA, 1863 bp, Bacillus thuringiensis (mutated)
  CDS (1)...(1863)
  misc_feature (0)...(0): NGSR.N49PVD
atgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccaaatggttcaagaaatggttcccgggccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacattaaatttagcaacagatagttcgctagcattgaaacataatttaggtgaagaccctaattcaacattatctggtatagtttacgttgaccgaatcgaattcatcccagtagattaa

SEQ ID NO: 20 - protein, 620 aa, Bacillus thuringiensis (mutated)
MSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRNGSRALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTLNLATDSSLALKHNLGEDPNSTLSGIVYVDRIEFIPVD

SEQ ID NO: 21 - DNA, 2022 bp, Bacillus thuringiensis (mutated)
  CDS (1)...(2022)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgacgaggttttcgacgaggtgccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagtaaatttagcaacagatagttcggtagcagtgaaacataatgtaggtgaagaccctaattcaacattatctggtatagtttacgttgaccgaatcgaattcatcccagtagatgagacatatgaagcggaataa

SEQ ID NO: 22 - protein, 673 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRRGFRRGALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNVGEDPNSTLSGIVYVDRIEFIPVDETYEAE

SEQ ID NO: 23 - DNA, 47 bp, Artificial Sequence
  KO forward primer
tttcgacgaggttttcgacgaggtgccttacgagatgtgcgaaatcg

SEQ ID NO: 24 - DNA, 45 bp, Artificial Sequence
  KO reverse primer
acctcgtcgaaaacctcgtcgaaatggaatttcttcccattcttc

SEQ ID NO: 25 - DNA, 2022 bp, Bacillus thuringiensis (mutated)
  CDS (1)...(2022)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccaaatggttcaagaaatggttcccgggccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacattaaatttagcaacagatagttcgctagcattgaaacataatgtaggtgaagaccctaattcaacattatctggtatagtttacgttgaccgaatcgaattcatcccagtagatgagacatatgaagcggaataa

SEQ ID NO: 26 - protein, 673 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRNGSRALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTLNLATDSSLALKHNVGEDPNSTLSGIVYVDRIEFIPVDETYEAE

SEQ ID NO: 27 - DNA, 20 bp, Artificial Sequence
  M4 forward primer
gaaacataatgtaggtgaag

SEQ ID NO: 28 - DNA, 20 bp, Artificial Sequence
  M4 reverse primer
cttcacctacattatgtttc

SEQ ID NO: 29 - DNA, 2022 bp, Bacillus thuringiensis (mutated)
  CDS (1)...(2022)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccaaatggttcaagaaatggttcccgggccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacattaaatttagcaacagatagttcgctagcagtgaaacataatgtaggtgaagaccctaattcaacattatctggtatagtttacgttgaccgaatcgaattcatcccagtagatgagacatatgaagcggaataa

SEQ ID NO: 30 - protein, 673 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRNGSRALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTLNLATDSSLAVKHNVGEDPNSTLSGIVYVDRIEFIPVDETYEAE

SEQ ID NO: 31 - DNA, 25 bp, Artificial Sequence
  M5 forward primer
gcagtgaaacataatgtaggtgaag

SEQ ID NO: 32 - DNA, 25 bp, Artificial Sequence
  M5 reverse primer
cttcacctacattatgtttcactgc

SEQ ID NO: 33 - DNA, 2022 bp, Bacillus thuringiensis (mutated)
  CDS (1)...(2022)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccaaatggttcaagaaatggttcccgggccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagtaaatttagcaacagatagttcggtagcagtgaaacataatgtaggtgaagaccctaattcaacattatctggtatagtttacgttgaccgaatcgaattcatcccagtagatgagacatatgaagcggaataa

SEQ ID NO: 34 - protein, 673 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRNGSRALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNVGEDPNSTLSGIVYVDRIEFIPVDETYEAE

SEQ ID NO: 35 - DNA, 54 bp, Artificial Sequence
  M6 forward primer
cacaacagtaaatttagcaacagatagttcggtagcagtgaaacataatgtagg

SEQ ID NO: 36 - DNA, 54 bp, Artificial Sequence
  M6 reverse primer
cctacattatgtttcactgctaccgaactatctgttgctaaatttactgttgtg

SEQ ID NO: 37 - DNA, 20 bp, Artificial Sequence
  pET28 forward primer
taatacgactcactataggg

SEQ ID NO: 38 - DNA, 19 bp, Artificial Sequence
  pET28 reverse primer
gctagttattgctcagcgg

SEQ ID NO: 39 - DNA, 2028 bp, Bacillus thuringiensis (mutated)
  CDS (1)...(2028)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgaagtcgaggttttcgaagtcgaggtccagccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatgtaggtgaagaccctaattcaacattatctggtatagtttacgttgaccgaatcgaattcatcccagtagatgagacatatgaagcggaa

SEQ ID NO: 40 - protein, 676 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRSRGFRSRGPALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNVGEDPNSTLSGIVYVDRIEFIPVDETYEAE

SEQ ID NO: 41 - DNA, 2025 bp, Bacillus thuringiensis (mutated)
  CDS (1)...(2025)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgaagtcgaggttttcgaagtcgaggtgccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatgtaggtgaagaccctaattcaacattatctggtatagtttacgttgaccgaatcgaattcatcccagtagatgagacatatgaagcggaa

SEQ ID NO: 42 - protein, 675 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRSRGFRSRGALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNVGEDPNSTLSGIVYVDRIEFIPVDETYEAE

SEQ ID NO: 43 - DNA, 2022 bp, Bacillus thuringiensis (mutated)
  CDS (1)...(2022)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccaaatggttcccggtttcgaagtcgaggtgccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatgtaggtgaagaccctaattcaacattatctggtatagtttacgttgaccgaatcgaattcatcccagtagatgagacatatgaagcggaa

SEQ ID NO: 44 - protein, 674 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRFRSRGALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNVGEDPNSTLSGIVYVDRIEFIPVDETYEAE

SEQ ID NO: 45 - DNA, 2025 bp, Bacillus thuringiensis (mutated)
  CDS (1)...(2025)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccaaatggttcccggtttcgaagtcgaggtccagccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatgtaggtgaagaccctaattcaacattatctggtatagtttacgttgaccgaatcgaattcatcccagtagatgagacatatgaagcggaa

SEQ ID NO: 46 - protein, 675 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRFRSRGPALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNVGEDPNSTLSGIVYVDRIEFIPVDETYEAE

SEQ ID NO: 47 - DNA, 2025 bp, Bacillus thuringiensis (mutated)
  CDS (1)...(2025)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgaagtcgaggtccaaatggttcccgggccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatgtaggtgaagaccctaattcaacattatctggtatagtttacgttgaccgaatcgaattcatcccagtagatgagacatatgaagcggaa

SEQ ID NO: 48 - protein, 675 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRSRGPNGSRALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNVGEDPNSTLSGIVYVDRIEFIPVDETYEAE

SEQ ID NO: 49 - DNA, 2022 bp, Bacillus thuringiensis (mutated)
  CDS (1)...(2022)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccaaatggttcccggtttcgaagtcgacaagccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatgtaggtgaagaccctaattcaacattatctggtatagtttacgttgaccgaatcgaattcatcccagtagatgagacatatgaagcggaa

SEQ ID NO: 50 - protein, 674 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRFRSRQALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNVGEDPNSTLSGIVYVDRIEFIPVDETYEAE

SEQ ID NO: 51 - DNA, 2031 bp, Bacillus thuringiensis (mutated)
  CDS (1)...(2031)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgaagtcgaggtagtttaaatggttcccggccagccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatgtaggtgaagaccctaattcaacattatctggtatagtttacgttgaccgaatcgaattcatcccagtagatgagacatatgaagcggaa

SEQ ID NO: 52 - protein, 677 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRSRGSLNGSRPALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNVGEDPNSTLSGIVYVDRIEFIPVDETYEAE

SEQ ID NO: 53 - DNA, 2019 bp, Bacillus thuringiensis (mutated)
  CDS (1)...(2019)
atgagtccaaataatcaaaatgaatatgaaattatagatgcgacaccttctacttctgtatccaatgattctaacagatacccttttgcgaatgagccaacaaatgcgctacaaaatatggattataaagattatgcagtagggtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgacgaggttttcgacgaggtgccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataacgtggtggatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacaataacgtacccaatagaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatgtaggtgaagaccctaattcaacattatctggtatagtttacgttgaccgaatcgaattcatcccagtagatgagacatatgaagcggaa

SEQ ID NO: 54 - protein, 673 aa, Bacillus thuringiensis (mutated)
MSPNNQNEYEIIDATPSTSVSNDSNRYPFANEPTNALQNMDYKDYAVGSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRRGFRRGALRDVRNRFEILDSLFTQYMPSFRVTNFEVPFLTVYAMAANLHLLLLKDASIFGEEWGWSTTTINNVVDRQMKLTAEYSDHCVKWYETGLAKLKGTSAKQWVDYNQFRREMTLAVLDVVALFPNYDTITYPIETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNVGEDPNSTLSGIVYVDRIEFIPVDETYEAE

SEQ ID NO: 55 - DNA, 2019 bp, Bacillus thuringiensis (mutated)
  CDS (1)...(2019)
atgagtccaaataatcaaaatgaatatgaaattatagatgcgacaccttctacttctgtatccaatgattctaacagatacccttttgcgaatgagccaacaaatgcgctacaaaatatggattataaagattatgcagtagggtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgacgaggttttcgacgaggtgccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacaataacgtacccaatagaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatgtaggtgaagaccctaattcaacattatctggtatagtttacgttgaccgaatcgaattcatcccagtagatgagacatatgaagcggaa

SEQ ID NO: 56 - protein, 673 aa, Bacillus thuringiensis (mutated)
MSPNNQNEYEIIDATPSTSVSNDSNRYPFANEPTNALQNMDYKDYAVGSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRRGFRRGALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTITYPIETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNVGEDPNSTLSGIVYVDRIEFIPVDETYEAE

SEQ ID NO: 57 - DNA, 2019 bp, Bacillus thuringiensis (mutated)
  CDS (1)...(2019)
atgagtccaaataatcaaaatgaatatgaaattatagatgcgacaccttctacttctgtatccaatgattctaacagatacccttttgcgaatgagccaacaaatgcgctacaaaatatggattataaagattatgcagtagggtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgacgaggttttcgacgaggtgccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgtacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatgtaggtgaagaccctaattcaacattatctggtatagtttacgttgaccgaatcgaattcatcccagtagatgagacatatgaagcggaa

SEQ ID NO: 58 - protein, 673 aa, Bacillus thuringiensis (mutated)
MSPNNQNEYEIIDATPSTSVSNDSNRYPFANEPTNALQNMDYKDYAVGSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRRGFRRGALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNVGEDPNSTLSGIVYVDRIEFIPVDETYEAE

SEQ ID NO: 59 - DNA, 2019 bp, Bacillus thuringiensis (mutated)
  CDS (1)...(2019)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgacgaggttttcgacgaggtgccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacaataacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatgtaggtgaagaccctaattcaacattatctggtatagtttacgttgaccgaatcgaattcatcccagtagatgagacatatgaagcggaa

SEQ ID NO: 60 - protein, 673 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRRGFRRGALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTITYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNVGEDPNSTLSGIVYVDRIEFIPVDETYEAE

SEQ ID NO: 61 - DNA, 2019 bp, Bacillus thuringiensis (mutated)
  CDS (1)...(2019)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgacgaggttttcgacgaggtgccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataacgtggtggatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacaataacgtacccaatagaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatgtaggtgaagaccctaattcaacattatctggtatagtttacgttgaccgaatcgaattcatcccagtagatgagacatatgaagcggaa

SEQ ID NO: 62 - protein, 673 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRRGFRRGALRDVRNRFEILDSLFTQYMPSFRVTNFEVPFLTVYAMAANLHLLLLKDASIFGEEWGWSTTTINNVVDRQMKLTAEYSDHCVKWYETGLAKLKGTSAKQWVDYNQFRREMTLAVLDVVALFPNYDTITYPIETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNVGEDPNSTLSGIVYVDRIEFIPVDETYEAE

SEQ ID NO: 63 - DNA, 2022 bp, Bacillus thuringiensis (mutated)
  CDS (1)...(2022)
atgagcccaaacaaccagaacgagtacgagatcatcgacgccaccccaagcaccagcgtgagcaacgacagcaacaggtacccattcgccaacgagccaaccaacgccctgcagaacatggactacaaggactacctgaagatgagcgccggcaacgccagcgagtacccaggcagcccagaggtgctggtgagcggccaggacgccgccaaggccgccatcgacatcgtgggcaagctgctgagcggcctgggcgtgccattcgtgggcccaatcgtgagcctgtacacccagctgatcgacatcctgtggccaagcggcgagaagagccagtgggagatcttcatggagcaggtggaggagctgatcaaccagaagatcgccgagtacgccaggaacaaggccctgagcgagctggagggcctgggcaacaactaccagctgtacctgaccgccctggaggagtgggaggagaacccattcaggaggggcttcaggaggggcgccctgagggacgtgaggaacaggttcgagatcctggacagcctgttcacccagtacatgccaagcttcagggtgaccaacttcgaggtgccattcctgaccgtgtacgccatggccgccaacctgcacctgctgctgctgaaggacgccagcatcttcggcgaggagtggggctggagcaccaccaccatcaacaactactacgacaggcagatgaagctgaccgccgagtacagcgaccactgcgtgaagtggtacgagaccggcctggccaagctgaagggcaccagcgccaagcagtgggtggactacaaccagttcaggagggagatgaccctggccgtgctggacgtggtggccctgttcccaaactacgacaccaggacctacccaatggagaccaaggcccagctgaccagggaggtgtacaccgacccactgggcgccgtgaacgtgagcagcatcggcagctggtacgacaaggccccaagcttcggcgtgatcgagagcagcgtgatcaggccaccacacgtgttcgactacatcaccggcctgaccgtgtacacccagagcaggagcatcagcagcgccaggtacatcaggcactgggccggccaccagatcagctaccacagggtgagcaggggcagcaacctgcagcagatgtacggcaccaaccagaacctgcacagcaccagcaccttcgacttcaccaactacgacatctacaagaccctgagcaaggacgccgtgctgctggacatcgtgtacccaggctacacctacatcttcttcggcatgccagaggtggagttcttcatggtgaaccagctgaacaacaccaggaagaccctgaagtacaacccagtgagcaaggacatcatcgcttctacaagagattctgagcttgagcttccaccagagacatctgatcagccaaattacgagtcttactctcatagactttgccatattacatctattccagctacaggtaatacaacaggtcttgttccagttttctcttggacacatagatctgctgatcttaataatacaatttactctgataagattacacagattccagctgttaagtgctgggataatcttccattcgttccagttgttaagggtccaggtcatacaggtggtgatcttcttcagtacaatagatctacaggttctgttggtacacttttccttgctagatacggtcttgctcttgagaaggctggtaagtacagagttagacttagatacgctacagatgctgatattgttcttcatgttaatgatgctcagattcagatgccaaagacaatgaatccaggtgaggatcttacatctaagacattcaaggttgctgatgctattacaacagttaatcttgctacagattcttctgttgctgttaagcataatgttggtgaggatccaaattctacactttctggtattgtttacgttgatagaattgagttcattccagttgatgagacatacgaggctgagtga

SEQ ID NO: 64 - protein, 673 aa, Bacillus thuringiensis (mutated); identical to SEQ ID NO: 22

SEQ ID NO: 65 - DNA, 2022 bp, Bacillus thuringiensis (mutated)
  CDS (1)...(2022)
atgagcccaaacaaccagaacgagtacgagatcatcgacgccaccccaagcaccagcgtgagcaacgacagcaaccgctacccattcgccaacgagccaaccaacgccctccagaacatggactacaaggactacctgaagatgagcgccggcaacgccagcgagtacccaggcagcccagaggtgctggtgagcggccaggacgccgccaaggccgccatcgacatcgtgggcaagctgctgagcggcctgggcgtgccattcgttggcccaatcgtgagcctgtacacccagctgatcgacatcctgtggccaagcggcgagaagagccagtgggagatcttcatggagcaggtggaggagctgatcaaccagaagatcgccgagtacgccaggaacaaggccctgagcgagctcgagggcctgggcaacaactaccagctgtacctgaccgccctggaggagtgggaggagaacccattcaggaggggcttcaggaggggcgccctgagggacgtgaggaacaggttcgagatcctggacagcctgttcacccagtacatgcctagcttcagggtgaccaacttcgaggtgccattcctgaccgtgtacgctatggccgccaacctgcacctgctgctgctgaaggacgccagcatcttcggcgaggagtggggctggagcaccaccaccatcaacaactactacgacaggcagatgaagctgaccgccgagtacagcgaccactgcgtgaagtggtacgagaccggcctggccaagctgaagggcaccagcgccaagcagtgggtggactacaaccagttcaggagggagatgaccctggccgtgctggacgtggtggccctgttcccaaactacgacaccaggacctacccaatggagaccaaggcccagctgaccagggaggtgtacaccgacccactgggcgccgtgaacgtgagcagcatcggcagctggtacgacaaggccccaagcttcggcgtgatcgagagcagcgtgatcaggccaccacacgtgttcgactacatcaccggcctgaccgtgtacacccagagcaggagcatcagcagcgccagatacatcaggcactgggccggccaccagatcagctaccacagggtgagcaggggcagcaacctgcagcagatgtacggcaccaaccagaacctgcacagcaccagcaccttcgacttcaccaactacgacatctacaagaccctgagcaaggacgccgtgctgctggacatcgtgtacccaggctacacctacatcttcttcggcatgccagaggtggagttcttcatggtgaaccagctgaacaacaccaggaagaccctgaagtacaacccagtgagcaaggacatcatcgcttctacaagagattctgagcttgagcttccaccagagacatctgatcagccaaattacgagtcttactctcatagactttgccatattacatctattccagctacaggcaatactacaggtcttgttccagttttctcttggacacatagatctgctgatcttaataatactatctactctgataagattacacagattccagctgttaagtgctgggataatcttccattcgttccagttgttaagggcccaggtcatacaggtggtgatcttcttcagtacaatagatctacaggttctgttggtacacttttccttgctagatacggtcttgctcttgagaaggctggtaagtacagagttagacttagatacgctacagatgctgatattgttcttcatgttaatgatgctcagattcagatgccaaagacaatgaatccaggcgaggatcttacatctaagacattcaaggttgctgatgctattacaacagttaatcttgctacagattcttctgttgctgttaagcacaatgttggcgaggacccaaattctacactttctggtattgtttacgttgataggattgagttcattccagttgatgagacatacgaggctgagtga

SEQ ID NO: 66 - protein, 673 aa, Bacillus thuringiensis (mutated); identical to SEQ ID NO: 22

SEQ ID NO: 67 - DNA, 2022 bp, Bacillus thuringiensis (mutated)
  CDS (1)...(2022)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgacgaggttttcgacgaggtgccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagtaaatttagcaacagatagttcggtagcagtgaaacataatttaggtgaagaccctaattcaacattatctggtatagtttacgttgaccgaatcgaattcatcccagtagatgagacatatgaagcggaataa

SEQ ID NO: 68 - protein, 673 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRRGFRRGALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNLGEDPNSTLSGIVYVDRIEFIPVDETYEAE

SEQ ID NO: 69 - DNA, 2022 bp, Bacillus thuringiensis (mutated)
  CDS (1)...(2022)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccaaatggttcaagaaatggttcccgggccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagtaaatttagcaacagatagttcggtagcagtgaaacataatttaggtgaagaccctaattcaacattatctggtatagtttacgttgaccgaatcgaattcatcccagtagatgagacatatgaagcggaataa

SEQ ID NO: 70 - protein, 673 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRNGSRALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNLGEDPNSTLSGIVYVDRIEFIPVDETYEAE

SEQ ID NO: 71 - DNA, 2028 bp, Bacillus thuringiensis (mutated)
  CDS (1)...(2028)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgaagtcgaggttttcgaagtcgaggtccagccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatttaggtgaagaccctaattcaacattatctggtatagtttacgttgaccgaatcgaattcatcccagtagatgagacatatgaagcggaa

SEQ ID NO: 72 - protein, 676 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRSRGFRSRGPALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNLGEDPNSTLSGIVYVDRIEFIPVDETYEAE

SEQ ID NO: 73 - DNA, 2025 bp, Bacillus thuringiensis (mutated)
  CDS (1)...(2025)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgaagtcgaggttttcgaagtcgaggtgccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatttaggtgaagaccctaattcaacattatctggtatagtttacgttgaccgaatcgaattcatcccagtagatgagacatatgaagcggaa

SEQ ID NO: 74 - protein, 675 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRSRGFRSRGALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNLGEDPNSTLSGIVYVDRIEFIPVDETYEAE

SEQ ID NO: 75 - DNA, 2022 bp, Bacillus thuringiensis (mutated)
  CDS (1)...(2022)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccaaatggttcccggtttcgaagtcgaggtgccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatttaggtgaagaccctaattcaacattatctggtatagtttacgttgaccgaatcgaattcatcccagtagatgagacatatgaagcggaa

SEQ ID NO: 76 - protein, 674 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRFRSRGALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNLGEDPNSTLSGIVYVDRIEFIPVDETYEAE

SEQ ID NO: 77 - DNA, 2025 bp, Bacillus thuringiensis (mutated)
  CDS (1)...(2022)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccaaatggttcccggtttcgaagtcgaggtccagccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatttaggtgaagaccctaattcaacattatctggtatagtttacgttgaccgaatcgaattcatcccagtagatgagacatatgaagcggaa

SEQ ID NO: 78 - protein, 675 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRFRSRGPALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNLGEDPNSTLSGIVYVDRIEFIPVDETYEAE

SEQ ID NO: 79 - DNA, 2025 bp, Bacillus thuringiensis (mutated)
  CDS (1)...(2025)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgaagtcgaggtccaaatggttcccgggccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatttaggtgaagaccctaattcaacattatctggtatagtttacgttgaccgaatcgaattcatcccagtagatgagacatatgaagcggaa

SEQ ID NO: 80 - protein, 675 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRSRGPNGSRALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNLGEDPNSTLSGIVYVDRIEFIPVDETYEAE

SEQ ID NO: 81 - DNA, 2022 bp, Bacillus thuringiensis (mutated)
  CDS (1)...(2022)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccaaatggttcccggtttcgaagtcgacaagccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatttaggtgaagaccctaattcaacattatctggtatagtttacgttgaccgaatcgaattcatcccagtagatgagacatatgaagcggaa

SEQ ID NO: 82 - protein, 674 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRFRSRQALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNLGEDPNSTLSGIVYVDRIEFIPVDETYEAE

SEQ ID NO: 83 - DNA, 2031 bp, Bacillus thuringiensis
  CDS (1)...(2031)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgaagtcgaggtagtttaaatggttcccggccagccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatttaggtgaagaccctaattcaacattatctggtatagtttacgttgaccgaatcgaattcatcccagtagatgagacatatgaagcggaa

SEQ ID NO: 84 - protein, 677 aa, Bacillus thuringiensis
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRSRGSLNGSRPALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNLGEDPNSTLSGIVYVDRIEFIPVDETYEAE

SEQ ID NO: 85 - DNA, 2019 bp, Bacillus thuringiensis (mutated)
  CDS (1)...(2019)
atgagtccaaataatcaaaatgaatatgaaattatagatgcgacaccttctacttctgtatccaatgattctaacagatacccttttgcgaatgagccaacaaatgcgctacaaaatatggattataaagattatgcagtagggtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgacgaggttttcgacgaggtgccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataacgtggtggatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacaataacgtacccaatagaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatttaggtgaagaccctaattcaacattatctggtatagtttacgttgaccgaatcgaattcatcccagtagatgagacatatgaagcggaa

SEQ ID NO: 86 - protein, 673 aa, Bacillus thuringiensis (mutated)
MSPNNQNEYEIIDATPSTSVSNDSNRYPFANEPTNALQNMDYKDYAVGSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRRGFRRGALRDVRNRFEILDSLFTQYMPSFRVTNFEVPFLTVYAMAANLHLLLLKDASIFGEEWGWSTTTINNVVDRQMKLTAEYSDHCVKWYETGLAKLKGTSAKQWVDYNQFRREMTLAVLDVVALFPNYDTITYPIETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNLGEDPNSTLSGIVYVDRIEFIPVDETYEAE

SEQ ID NO: 87 - DNA, 2019 bp, Bacillus thuringiensis (mutated)
  CDS (1)...(2019)
atgagtccaaataatcaaaatgaatatgaaattatagatgcgacaccttctacttctgtatccaatgattctaacagatacccttttgcgaatgagccaacaaatgcgctacaaaatatggattataaagattatgcagtagggtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgacgaggttttcgacgaggtgccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacaataacgtacccaatagaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatttaggtgaagaccctaattcaacattatctggtatagtttacgttgaccgaatcgaattcatcccagtagatgagacatatgaagcggaa

SEQ ID NO: 88 - protein, 673 aa, Bacillus thuringiensis (mutated)
MSPNNQNEYEIIDATPSTSVSNDSNRYPFANEPTNALQNMDYKDYAVGSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRRGFRRGALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTITYPIETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNLGEDPNSTLSGIVYVDRIEFIPVDETYEAE

SEQ ID NO: 89 - DNA, 2019 bp, Bacillus thuringiensis (mutated)
  CDS (1)...(2019)
atgagtccaaataatcaaaatgaatatgaaattatagatgcgacaccttctacttctgtatccaatgattctaacagatacccttttgcgaatgagccaacaaatgcgctacaaaatatggattataaagattatgcagtagggtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgacgaggttttcgacgaggtgccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgtacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatttaggtgaagaccctaattcaacattatctggtatagtttacgttgaccgaatcgaattcatcccagtagatgagacatatgaagcggaa

SEQ ID NO: 90 - protein, 673 aa, Bacillus thuringiensis (mutated)
MSPNNQNEYEIIDATPSTSVSNDSNRYPFANEPTNALQNMDYKDYAVGSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRRGFRRGALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNLGEDPNSTLSGIVYVDRIEFIPVDETYEAE

SEQ ID NO: 91 - DNA, 2019 bp, Bacillus thuringiensis (mutated)
  CDS (1)...(2019)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgacgaggttttcgacgaggtgccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacaataacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatttaggtgaagaccctaattcaacattatctggtatagtttacgttgaccgaatcgaattcatcccagtagatgagacatatgaagcggaa

SEQ ID NO: 92 - protein, 673 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRRGFRRGALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTITYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNLGEDPNSTLSGIVYVDRIEFIPVDETYEAE

SEQ ID NO: 93 - DNA, 2019 bp, Bacillus thuringiensis (mutated)
  CDS (1)...(2019)
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccatttcgacgaggttttcgacgaggtgccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataacgtggtggatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacaataacgtacccaatagaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagatttaaacaatacaatatattcagataaaatcactcaaattccggccgttaaatgttgggataatttaccgtttgttccagtggtaaaaggaccaggacatacaggaggggatttattacagtataatagaagtactggttctgtaggaaccttatttctagctcgatatggcctagcattagaaaaagcagggaaatatcgtgtaagactgagatatgctactgatgcagatattgtattgcatgtaaacgatgctcagattcagatgccaaaaacaatgaacccaggtgaggatctgacatctaaaacttttaaagttgcagatgctatcacaacagttaatttagcaacagatagttcggttgcagttaaacataatttaggtgaagaccctaattcaacattatctggtatagtttacgttgaccgaatcgaattcatcccagtagatgagacatatgaagcggaa

SEQ ID NO: 94 - protein, 673 aa, Bacillus thuringiensis (mutated)
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPFRRGFRRGALRDVRNRFEILDSLFTQYMPSFRVTNFEVPFLTVYAMAANLHLLLLKDASIFGEEWGWSTTTINNVVDRQMKLTAEYSDHCVKWYETGLAKLKGTSAKQWVDYNQFRREMTLAVLDVVALFPNYDTITYPIETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTVNLATDSSVAVKHNLGEDPNSTLSGIVYVDRIEFIPVDETYEAE

SEQ ID NO: 95 - protein, 5 aa, Bacillus thuringiensis (mutated)
FRSRG

SEQ ID NO: 96 - protein, 11 aa, Bacillus thuringiensis (mutated)
FRSRGFRSRGP

SEQ ID NO: 97 - protein, 4 aa, Bacillus thuringiensis (mutated)
FRRG

SEQ ID NO: 98 - protein, 8 aa, Bacillus thuringiensis (mutated)
FRRGFRRG

SEQ ID NO: 99 - protein, 21 aa, Bacillus thuringiensis
ITTLNLATDSSLALKHNLGED

SEQ ID NO: 100 - protein, 21 aa, Bacillus thuringiensis (mutated)
ITTLNLATDSSLALKHNVGED

SEQ ID NO: 101 - protein, 21 aa, Bacillus thuringiensis (mutated)
ITTLNLATDSSLAVKHNVGED

SEQ ID NO: 102 - protein, 21 aa, Bacillus thuringiensis (mutated)
ITTVNLATDSSVAVKHNLGED

SEQ ID NO: 103 - protein, 21 aa, Bacillus thuringiensis (mutated)
ITTVNLATDSSVAVKHNVGED

SEQ ID NO: 104 - protein, 12 aa, Bacillus thuringiensis
DYKDYLKMSAGN

SEQ ID NO: 105 - protein, 12 aa, Bacillus thuringiensis (mutated)
DYKDYAVGSAGN

SEQ ID NO: 106 - protein, 8 aa, Bacillus thuringiensis
INNYYDRQ

SEQ ID NO: 107 - protein, 8 aa, Bacillus thuringiensis (mutated)
INNVVDRQ

SEQ ID NO: 108 - protein, 13 aa, Bacillus thuringiensis
NYDTRTYPMETKA

SEQ ID NO: 109 - protein, 13 aa, Bacillus thuringiensis (mutated)
NYDTITYPIETKA

SEQ ID NO: 110 - protein, 8 aa, Bacillus thuringiensis (mutated)
NGSRNGSR

SEQ ID NO: 111 - protein, 10 aa, Bacillus thuringiensis (mutated)
PFRRLKMFFA

SEQ ID NO: 112 - protein, 10 aa, Bacillus thuringiensis (mutated)
FRSRGFRSRG

SEQ ID NO: 113 - protein, 12 aa, Bacillus thuringiensis (mutated)
FRSRGSLNGSRP

SEQ ID NO: 114 - protein, 9 aa, Bacillus thuringiensis
NPNGSRALR

SEQ ID NO: 115 - protein, 13 aa, Bacillus thuringiensis (mutated)
NPNGSRNGSRALR

SEQ ID NO: 116 - protein, 13 aa, Bacillus thuringiensis (mutated)
NPFRRGFRRGALR

SEQ ID NO: 117 - protein, 5 aa, Bacillus thuringiensis (mutated)
FRSRQ

SEQ ID NO: 118 - DNA, 1173 bp, Pentaclethra macroloba (mutated)
  CDS (1)...(1173)
atggctgatgtggcaggctccacaggtgcgggagcttctaaagatggaaacttagtcacagttcttgccattgatggaggtggtatcagaggaattatccccggagttattctcaaacaactagaagctactcttcagagatgggactcaagtgcaagactagcagagtattttgatgtggttgccgggacggtcactggagggattataactgccattctaactgccccggacccacaaaacaaggaccgtcctttgtatgctgccgaagaaattatcgacttctacatagagcatggtccttccatttttaataaatccaccgcctgctcgttgcctggtatcttttgtccaaagtatgatgggaagtatttacaagaaataataagccagaaattgaatgaaacactactagaccagacaacaacaaatgttgttatcccttccttcgacatcaagcttcttcgtccaaccatattctcaactttcaagttagaggaagttcctgagttaaatgtcaaactctccgatgtatgcatgggaacttcagcagcaccaatcgtatttcctccctattatttcaagcatggagatactgaattcaatctcgttgatggtgcaatcatcgctgatattccggccccggttgctctcagcgaggtgctccagcaagaaaaatacaagaataaagaaatccttttgctgtctataggaactggagttgtaaaacctggtgagggttattctgctaatcgtacttggactattttcgattggagtagtgaaactttaatcgggcttatgggtcatggaacgagagccatgtctgattattacgttggctcacatttcaaagcccttcaaccccagaataactacctccgaattcaggaatacgatttagatccggcactggaaagcattgatgatgcttcaacggaaaacatggagaatctggaaaaggtaggacagagtttgttgaacgaaccagttaaaaggatgaatctgaatacttttgtcgttgaagaaacaggtgaaggtaccaatgcagaagctttagacaggctggctcagattctttatgaagaaaagattactcgtggtctcggaaagatatctttggaagtggataacattgatccatatactgaacgtgttaggaaactgctattc

SEQ ID NO: 119 - protein, 391 aa, Pentaclethra macroloba (mutated)
MADVAGSTGAGASKDGNLVTVLAIDGGGIRGIIPGVILKQLEATLQRWDSSARLAEYFDVVAGTVTGGIITAILTAPDPQNKDRPLYAAEEIIDFYIEHGPSIFNKSTACSLPGIFCPKYDGKYLQEIISQKLNETLLDQTTTNVVIPSFDIKLLRPTIFSTFKLEEVPELNVKLSDVCMGTSAAPIVFPPYYFKHGDTEFNLVDGAIIADIPAPVALSEVLQQEKYKNKEILLLSIGTGVVKPGEGYSANRTWTIFDWSSETLIGLMGHGTRAMSDYYVGSHFKALQPQNNYLRIQEYDLDPALESIDDASTENMENLEKVGQSLLNEPVKRMNLNTFVVEETGEGTNAEALDRLAQILYEEKITRGLGKISLEVDNIDPYTERVRKLLF

SEQ ID NO: 120 - DNA, 1173 bp, Pentaclethra macroloba (mutated)
  CDS (1)...(1173)
atggctgatgtggcaggctccacaggtgcgcatgcttctaaagatggaaacttagtcacagttcttgccattgatggaggtggtatcagaggaattatccccggagttattctcaaacaactagaagctactcttcagagatgggactcaagtgcaagactagcagagtattttgatgtggttgccgggacggtcactggagggattataactgccattctaactgccccggacccacaaaacaaggaccgtcctttgtatgctgccgaagaaattatcgacttctacatagagcatggtccttccatttttaataaatccaccgcctgctcgttgcctggtatcttttgtccaaagtatgatgggaagtatttacaagaaataataagccagaaattgaatgaaacactactagaccagacaacaacaaatgttgttatcccttccttcgacatcaagcttcttcgtccaaccatattctcaactttcaagttagaggaagttcctgagttaaatgtcaaactctccgatgtatgcatgggaacttcagcagcaccaatcgtatttcctccctattatttcaagcatggagatactgaattcaatctcgttgatggtgcaatcatcgctgatattccggccccggttgctctcagcgaggtgctccagcaagaaaaatacaagaataaagaaatccttttgctgtctataggaactggagttgtaaaacctggtgagggttattctgctaatcgtacttggactattttcgattggagtagtgaaactttaatcgggcttatgggtcatggaacgagagccatgtctgattattacgttggctcacatttcaaagcccttcaaccccagaataactacctccgaattcaggaatacgatttagatccggcactggaaagcattgatgatgcttcaacggaaaacatggagaatctggaaaaggtaggacagagtttgttgaacgaaccagttaaaaggatgaatctgaatacttttgtcgttgaagaaacaggtgaaggtaccaatgcagaagctttagacaggctggctcagattctttatgaagaaaagattactcgtggtctcggaaagatatctttggaagtggataacattgatccatatactgaacgtgttaggaaactgctattc

SEQ ID NO: 121 - protein, 391 aa, Pentaclethra macroloba (mutated)
MADVAGSTGAHASKDGNLVTVLAIDGGGIRGIIPGVILKQLEATLQRWDSSARLAEYFDVVAGTVTGGIITAILTAPDPQNKDRPLYAAEEIIDFYIEHGPSIFNKSTACSLPGIFCPKYDGKYLQEIISQKLNETLLDQTTTNVVIPSFDIKLLRPTIFSTFKLEEVPELNVKLSDVCMGTSAAPIVFPPYYFKHGDTEFNLVDGAIIADIPAPVALSEVLQQEKYKNKEILLLSIGTGVVKPGEGYSANRTWTIFDWSSETLIGLMGHGTRAMSDYYVGSHFKALQPQNNYLRIQEYDLDPALESIDDASTENMENLEKVGQSLLNEPVKRMNLNTFVVEETGEGTNAEALDRLAQILYEEKITRGLGKISLEVDNIDPYTERVRKLLF

SEQ ID NO: 122 - DNA, 1173 bp, Pentaclethra macroloba (mutated)
  CDS (1)...(1173)
atggctgatgtggcaggctccacacacgcgcatgcttctaaagatggaaacttagtcacagttcttgccattgatggaggtggtatcagaggaattatccccggagttattctcaaacaactagaagctactcttcagagatgggactcaagtgcaagactagcagagtattttgatgtggttgccgggacggtcactggagggattataactgccattctaactgccccggacccacaaaacaaggaccgtcctttgtatgctgccgaagaaattatcgacttctacatagagcatggtccttccatttttaataaatccaccgcctgctcgttgcctggtatcttttgtccaaagtatgatgggaagtatttacaagaaataataagccagaaattgaatgaaacactactagaccagacaacaacaaatgttgttatcccttccttcgacatcaagcttcttcgtccaaccatattctcaactttcaagttagaggaagttcctgagttaaatgtcaaactctccgatgtatgcatgggaacttcagcagcaccaatcgtatttcctccctattatttcaagcatggagatactgaattcaatctcgttgatggtgcaatcatcgctgatattccggccccggttgctctcagcgaggtgctccagcaagaaaaatacaagaataaagaaatccttttgctgtctataggaactggagttgtaaaacctggtgagggttattctgctaatcgtacttggactattttcgattggagtagtgaaactttaatcgggcttatgggtcatggaacgagagccatgtctgattattacgttggctcacatttcaaagcccttcaaccccagaataactacctccgaattcaggaatacgatttagatccggcactggaaagcattgatgatgcttcaacggaaaacatggagaatctggaaaaggtaggacagagtttgttgaacgaaccagttaaaaggatgaatctgaatacttttgtcgttgaagaaacaggtgaaggtaccaatgcagaagctttagacaggctggctcagattctttatgaagaaaagattactcgtggtctcggaaagatatctttggaagtggataacattgatccatatactgaacgtgttaggaaactgctattc

SEQ ID NO: 123 - protein, 391 aa, Pentaclethra macroloba (mutated)
MADVAGSTHAHASKDGNLVTVLAIDGGGIRGIIPGVILKQLEATLQRWDSSARLAEYFDVVAGTVTGGIITAILTAPDPQNKDRPLYAAEEIIDFYIEHGPSIFNKSTACSLPGIFCPKYDGKYLQEIISQKLNETLLDQTTTNVVIPSFDIKLLRPTIFSTFKLEEVPELNVKLSDVCMGTSAAPIVFPPYYFKHGDTEFNLVDGAIIADIPAPVALSEVLQQEKYKNKEILLLSIGTGVVKPGEGYSANRTWTIFDWSSETLIGLMGHGTRAMSDYYVGSHFKALQPQNNYLRIQEYDLDPALESIDDASTENMENLEKVGQSLLNEPVKRMNLNTFVVEETGEGTNAEALDRLAQILYEEKITRGLGKISLEVDNIDPYTERVRKLLF

SEQ ID NO: 124 - protein, 4 aa, Artificial Sequence
  amino acids added to N-terminus to enhance production of modified pentin-1 protein in a host cell
MADV

SEQ ID NO: 125 - protein, 15 aa, Pentaclethra macroloba (mutated)
  sequence from modified pentin-1 protein
MADVAFSTQAKASKD

SEQ ID NO: 126 - protein, 30 aa, Pentaclethra macroloba (mutated)
MADVAFSTQAKASKDGNLVTVLAIDGGGIR

SEQ ID NO: 127 - protein, 30 aa, Pentaclethra macroloba (mutated)
MADVAGSTGAGASKDGNLVTVLAIDGGGIR

SEQ ID NO: 128 - protein, 30 aa, Pentaclethra macroloba (mutated)
MADVAGSTGAHASKDGNLVTVLAIDGGGIR

SEQ ID NO: 129 - protein, 30 aa, Pentaclethra macroloba (mutated)
MADVAGSTHAHASKDGNLVTVLAIDGGGIR

SEQ ID NO: 130 - DNA, 30 bp, Artificial Sequence
  primer
gccacatcagccatggccttgtcgtcgtcg

SEQ ID NO: 131 - DNA, 60 bp, Artificial Sequence
  NEZ1 mutation forward primer
gacaaggccatggctgatgtggcaggctccacaggtgcgggagcttctaaagatggaaac

SEQ ID NO: 132 - DNA, 60 bp, Artificial Sequence
  NEZ2 mutation forward primer
gacaaggccatggctgatgtggcaggctccacaggtgcgcatgcttctaaagatggaaac

SEQ ID NO: 133 - DNA, 60 bp, Artificial Sequence
  NEZ3 mutation forward primer
gacaaggccatggctgatgtggcaggctccacacacgcgcatgcttctaaagatggaaac

SEQ ID NO: 134 - DNA, 30 bp, Artificial Sequence
  modified 5' end of pentin-1 sequence
cgacgacgacaaggccatggctgatgtggc

That which is claimed:

1. An isolated pesticidal polypeptide comprising the amino acid sequence set forth in SEQ ID No: 22.

2. The polypeptide according to claim 1, wherein said polypeptide is characterized by pesticidal activity against at least one pest belonging to the order Coleoptera.

3. A pesticidal composition comprising at least one polypeptide according to claim 1 in combination with a carrier.

4. The pesticidal composition of claim 3, further comprising an additional *Bacillus thuringiensis* toxin.

5. The pesticidal composition of claim 4, wherein said additional *Bacillus thuringiensis* toxin is a Cry3B toxin.

6. A method for impacting an insect pest comprising applying the pesticidal composition according to claim 3 to the environment of the insect pest by a procedure selected from the group consisting of spraying, dusting, broadcasting, and seed coating.

7. The method according to claim 6, wherein said insect pest is selected from the group consisting of Colorado potato beetle, western corn rootworm, southern corn rootworm, and boll weevil.

* * * * *